US009976154B2

(12) United States Patent
Allen et al.

(10) Patent No.: US 9,976,154 B2
(45) Date of Patent: May 22, 2018

(54) SUCROSE TRANSPORTER GENES FOR INCREASING PLANT SEED LIPIDS

(71) Applicant: E I DU PONT DE NEMOURS AND COMPANY, Wilmington, DE (US)

(72) Inventors: Stephen M Allen, Wilmington, DE (US); Howard Glenn Damude, Hockessin, DE (US); John D Everard, Wilmington, DE (US); Knut Meyer, Wilmington, DE (US); Byung-Chun Yoo, Newark, DE (US)

(73) Assignee: E. I. DU PONT DE NEMOURS AND COMPANY, Wilmington, DE (US)

( * ) Notice: Subject to any disclaimer, the term of this patent is extended or adjusted under 35 U.S.C. 154(b) by 473 days.

(21) Appl. No.: 14/666,813

(22) Filed: Mar. 24, 2015

(65) Prior Publication Data
US 2015/0218577 A1 Aug. 6, 2015

Related U.S. Application Data

(62) Division of application No. 12/917,024, filed on Nov. 1, 2010, now Pat. No. 8,993,840.

(60) Provisional application No. 61/263,660, filed on Nov. 23, 2009.

(51) Int. Cl.
*C12N 15/82* (2006.01)
*C07K 14/415* (2006.01)
*C12N 9/10* (2006.01)
*C12Q 1/68* (2018.01)

(52) U.S. Cl.
CPC ........ *C12N 15/8247* (2013.01); *C07K 14/415* (2013.01); *C12N 9/1029* (2013.01); *C12Q 1/6895* (2013.01); *C12Q 2600/13* (2013.01); *C12Q 2600/16* (2013.01); *C12Y 203/0102* (2013.01)

(58) Field of Classification Search
None
See application file for complete search history.

(56) References Cited

U.S. PATENT DOCUMENTS

| 6,100,077 | A  | 8/2000  | Sturley et al.    |
| 6,344,548 | B1 | 2/2002  | Farese, Jr. et al. |
| 6,995,301 | B1 | 2/2006  | Shorrosh          |
| 7,273,746 | B2 | 9/2007  | Yadav et al.      |
| 7,323,560 | B2 | 1/2008  | Allen et al.      |
| 7,423,203 | B2 | 9/2008  | Cheikh et al.     |
| 8,143,473 | B2 | 3/2012  | Meyer et al.      |
| 8,143,476 | B2 | 3/2012  | Meyer et al.      |
| 8,927,809 | B2 | 1/2015  | Meyer et al.      |
| 2003/0115632 | A1 | 6/2003 | Lardizabal et al. |
| 2003/0163846 | A1 | 8/2003 | Ward et al.       |
| 2004/0031072 | A1 | 2/2004 | La Rosa et al.    |
| 2006/0094088 | A1 | 5/2006 | Picataggio et al. |
| 2008/0095915 | A1 | 4/2008 | Damude et al.     |
| 2008/0295204 | A1 | 11/2008 | Meyer et al.     |
| 2009/0183270 | A1 | 7/2009 | Adams et al.      |
| 2015/0101080 | A1 | 4/2015 | Damude et al.     |

FOREIGN PATENT DOCUMENTS

| WO | 1998/055631 A1 | 12/1998 |
| WO | 1999/67403     | 12/1999 |
| WO | 2000/001713 A2 | 1/2000  |
| WO | 2001/73086 A2  | 10/2001 |
| WO | 2011/85963 A2  | 11/2001 |
| WO | 2004/011671 A2 | 2/2004  |
| WO | 2005/003322 A2 | 1/2005  |
| WO | 2008/147935 A2 | 12/2008 |
| WO | 2009/009142 A2 | 1/2009  |

OTHER PUBLICATIONS

Hackel et al 2006 (The Plant Journal 45: p. 180-192).*
Stewart et al 1996 (Plant Physiology 112: p. 112-129).*
Barth, I., et al., "PmSUC3: Characterization of a SUT2/SUC3-Type Sucrose Transporter from *Plantago major,*" *The Plant Cell*, 2003, vol. 15, pp. 1375-1385.
Kristen A Bennett et al., Modification of Seed Oil Content in Soybean (Glycine max) by Expression of a Mortierella Remanniana Diacylglycerol Acyltransferase. Annual Meeting of the American Society of Plant Biologists, Plant Biology, 2004.
George Bruening, Plant gene silencing regularized, Proc. Natl. Acad. Sci USA, Nov. 1998, pp. 13349-13351, vol. 95.
Conde, C., et al., "OeMST2 Encodes A Monosaccharide Transporter Expressed Throughout Olive Fruit Maturation," *Plant Cell Physiol.*, 2007, pp. 1299-1308, vol. 48(9).
Mark L. Dahmer et al., A Rapid Screening Technique for Determining the Lipid Composition of Soybean Seeds, Journal of American Oil Chemists Society, Apr. 1989, pp. 543-548, vol. 66, No. 4.
Eckardt, N., et al., "The Function of SUT2/SUC3 Sucrose Transporters: The Debate Continues," *The Plant Cell*, 2003, vol. 14, pp. 1259-1262.
John Vargas Eyre, Notes on Oil Development in the Seed of a Growing Plant, Biochemical Journal, 1931, pp. 1902-1908, vol. 25:6.
Iddo Friedberg, Automated protein function prediction—the genomic challenge, Briefings in Bioinformatics, 2006, pp. 225-242, vol. 7, No. 3.
David Hildebrand et al., Genomics of Soybean Oil Traits. Genetics and Genomics of Soybean Springer, Plant Genetics and Genomics—Crops and Models, p. 185-209, 2008.

(Continued)

*Primary Examiner* — Matthew R Keogh
(74) *Attorney, Agent, or Firm* — E I Du Pont De Nemours & Co.

(57) ABSTRACT

This invention relates to polynucleotide sequences encoding SUT2 or SUT4 sucrose transporter genes. Methods for increasing seed oil content and evaluating increased oil content in a plant seed are described. The compositions and methods disclosed herein employ a variety of sequences that encode sucrose transporters and a variety of sequences that influence fatty acid accumulation, including for example, DGAT, Lec1 and ODP1 transcription factor. In specific embodiments, overexpression of SUT2 and/or SUT4 sucrose transporters in combination with DGAT genes further increase plant seed oil production compared to a high oil plant comprising recombinant DNA constructs that do not overexpress SUT2 or SUT4 transporters.

21 Claims, 30 Drawing Sheets

(56) References Cited

OTHER PUBLICATIONS

Colette Jako et al., Seed-Specific Over-Expression of an *Arabidopsis* cDNA Encoding a Diacylglycerol Acyltransferase Enhances Seed Oil Content and Seed Weight, Plant Physiology, Jun. 2001, pp. 861-874, vol. 126.

Katavic et al., Alteration of Seed Fatty Acid Composition by an Ethyl Methanesulfonate-Induced Mutation in *Arabidopsis thaliana* Affecting Diacylglycerol Acyltransferase Activity, Plant Physiology, 1995, vol. 108, pp. 399-409.

Marianne T. Kaup et al., A Role for Diacylglycerol Acyltransferase during Leaf Senescence, Plant Physiology, Aug. 2002, pp. 1616-1626, vol. 129.

Kühn, C., et al., "A Comparison of the Sucrose Transporter Systems of Different Plant Species," *Plant Biol.*, 2003, pp. 215-232, vol. 5.

Lardizabel et al., DGAT2 is a New Diacylglycerol Acyltransferase Gene Family. Purification, Cloning and Expression in Insect Cells of Two Polypeptides from Montierella Ramanniana with Diacylglycerol Acyltransferase Activity, Journal of Biological Chemistry, 2001, pp. 38862-38869, vol. 278(42).

Leggewie, G., et al. "Overexpression of the Sucrose Transporter SoSUT1 in Potato Results in Alterations in Leaf Carbon Partitioning and in Tuber Metabolism but has Little Impact on Tuber Morphology," *Planta*, 2003, pp. 158-167, vol. 217.

Lim, J.D., et al., "Sucrose Transport From Source to Sink Seeds in Rice," *Physiologia Plantarum*, 2006, pp. 572-584, vol. 126.

Meyer, S., et al., "Wounding Enhances Expression of AtSUC3, A Sucrose Transporter From *Arabidopsis* Sieve Elements and Sink Tissues," *Plant Physiology*, 2004, pp. 684-693, vol. 134.

Umi S. Ramli et al., Control analysis of lipid biosynthesis intissue cultures from oil crops shows that flux control is shared between fatty acid synthesis and lipid assembly, Biochem J., 2002, pp. 393-401, vol. 364.

Rosche, E., et al., "Seed-Specific Overexpression of a Potato Sucrose Transporter Increases Sucrose Uptake and Growth Rates of Developing Pea Cotyledons," *The Plant Journal*, 2002, pp. 165-175, vol. 30(2).

Sauer, N., "Molecular Physiology of Higher Plant Sucrose Transporters," *FEBS Letters*, 2007, pp. 2309-2317, vol. 581(12).

Tamura, K., "MEGA4: Molecular Evolutionary Genetics Analysis (MEGA) Software Version 4.0," *Mol. Biol. Evol.*, pp. 1596-1599, vol. 24(8).

Weise, A., et al., "A New Subfamily of Sucrose Transporters, SUT4, with Low Affinity/High Capacity Localized in Enucleate Sieve Elements of Plants," *The Plant Cell*, 2000, vol. 12, pp. 1345-1355.

Yen et al., DGAT enzymes and triacylglycerol biosynthesis, Journal of Lipid Research, Nov. 2008, pp. 2283-2301, vol. 49, XP055212988.

U.S. Appl. No. 61/263,660, Stephen M Allen et al., filed Nov. 23, 2009.

International Search Report—PCT/2008/064621, dated Jul. 2, 2009.

International Search Report—PCT/US2010/054942, dated May 6, 2011.

Communication for EP Application No. 10773823.9, dated Sep. 21, 2015.

\* cited by examiner

| | | | | | | | | |
|---|---|---|---|---|---|---|---|---|
| 350 | SVLVNLLTSLRHLPPAMHS | VLIVMALTWLSWFPFLFDTDWMGREVYHGD | SEQ ID NO 4 |
| 357 | AVLVNLLTSLRHLPPAMHS | VLVVMALTWLSWFPFLFDTDWMGREVYHGD | SEQ ID NO 34 |
| 375 | AVLVNLLTSLRHLPPAMHS | VLVVMALTWLSWFPFLFDTDWMGREVYHGD | SEQ ID NO 36 |
| 361 | AVLVNLLTSLRHLPPAMHS | VLVVMALTWVSWFPFLFDTDWMGREVYHGD | SEQ ID NO 41 |
| 361 | AVLVNLLTSLRHLPPAMHS | VLIVMALTWLPWFPFLFDTDWMGREVYHGD | SEQ ID NO 42 |
| 361 | AVLVNLLTSLRHLPPAMHS | VLIVMALTWLSWFPFLFDTDWMGREVYHGD | SEQ ID NO 43 |
| 360 | AVLVNLLTSLRHLPPAMHS | VLLVMALTWLSWFPFLFDTDWMGREVYHGD | SEQ ID NO 44 |
| 350 | AVLVNLLTSMRHLPPAMHS | VLIVMALTWLSWFPFLFDTDWMGREVYHGD | SEQ ID NO 45 |
| 347 | AVLVNILTRMRHLPPGMYS | VLLVMALTWLSWFPFLFDTDWMGREMYHGK | SEQ ID NO 46 |
| 265 | AVFK--G-MKNLPPGMPQ | VLIVTGLTWLSWFPFILFDTDWMGREVYNGD | SEQ ID NO 47 |
| 353 | AVLVNLLTSLRHLPPAMHS | VLVVMALTWLSWFPFLFDTDWMGREVYHGD | SEQ ID NO 48 |
| 363 | AVLVNLLTSLRHLPPGMHS | VLVVMALTWLSWFPFLFDTDWMGREVYHGD | SEQ ID NO 49 |
| 366 | AVLVNLLTSLRHLPPGMHS | VLVVMALTWLSWFPFLFDTDWMGREVYHGD | SEQ ID NO 50 |
| 290 | AVLVNILTSMRHLPPGMHS | VLLVMALTWLSWFPFLFDTDWMGREVYHGD | SEQ ID NO 52 |
| 256 | AVFK--G-FKNLPRGMPS | VLLVTGLTWLSWFPFILYDTDWMGREIYHGD | SEQ ID NO 150 |
| | | | |
| 400 | PTGD-SLHMELYDQG | VREGALGLLLNSVVLGISSFLIEPMCQRMGARVVW | SEQ ID NO 4 |
| 407 | PKGD-TSEVDLYDQG | VREGAAFGLLLNSVVLGISSFFIEPMCKWMGAKLVW | SEQ ID NO 34 |
| 425 | PKGG-TSEVDLYDQG | VREGAAFGLLLNSVVLGISSFFIEPMCKWMGAKLVW | SEQ ID NO 36 |
| 411 | PKGN-DHEVKFYDQG | VREGAAFGLLLNSVVLGVSSFLIEPMCRWIGSRLVW | SEQ ID NO 41 |
| 411 | PKGD-AAAEVRAYDQG | VREGAAFGLLLNSVVLGVSSFLIEPMCQRLGSRLVW | SEQ ID NO 42 |
| 411 | PKGE-ADEVNAYNQG | VREGAAFGLLLNSVVLGVSSFLIEPMCKWIGSRLVW | SEQ ID NO 43 |
| 410 | PKGE-ADEVNAYNQG | VREGAAFGLLLNSVVLGVSSFLIEPMCKWIGSRLVW | SEQ ID NO 44 |
| 400 | PNGN-LSERKAYDNG | VREGAAFGLLLNSVVLGIGSFLIEPMCRLMGARLVW | SEQ ID NO 45 |
| 397 | PNGD-LSERKAYDNG | VREGAAFGLLLNSVVLGVGSFLIEPMCRLMGARLVW | SEQ ID NO 46 |
| 311 | PDGS-PTEVANYQEG | VREGQAFGLLLNSIVLGVSSFLLIEPMCRKLTAKVVW | SEQ ID NO 47 |
| 403 | PKGETAAAKVQAYNQG | VREGAAFGLLLNSVVLGISSFLLIEPMCKRMGARLVW | SEQ ID NO 48 |
| 413 | PKGN-SDEAKFYDQG | VREGAAFGLLLNSVVLGISSFLIEPMCQRMGPRLVW | SEQ ID NO 49 |
| 416 | PKGN-SDEVKLYDQG | VREGAAFGLLLNSVVLGISSFLVDPLCQRMGPRLVW | SEQ ID NO 50 |
| 340 | PNGD-PTERRAYDNG | VREGAAFGLLLNSVVLGIGSFLVDPLCRLIGARLVW | SEQ ID NO 52 |
| 302 | PKGT-NAQVAAFDEG | VRVGAFGLLLNSIVLGLTSFLIEPMCRKVGPRLVW | SEQ ID NO 150 |

| | | | | | | | | | | | | | | | | | | |
|---|---|---|---|---|---|---|---|---|---|---|---|---|---|---|---|---|---|---|
| 548 | P W D Q L F G G G N L P A F V L A S V A A F A A G V I A L Q R L P T L S S - F K S T G F H - I G | SEQ ID NO 4 |
| 555 | P W D A L F G G G N I P A F V L A S V C A L A G A V I A T L K L P D L S S - F Q S T G F H - I G | SEQ ID NO 34 |
| 573 | P W D A L F G G G N I P A F V L A S L C A L A G G V I A T L K L P D L S S - F Q S T G F H - I G | SEQ ID NO 36 |
| 560 | P W D A L F G G G N I P A F G L A S L S A L A A G V I A T L K L P H L S S - F T S S G F H - I G | SEQ ID NO 41 |
| 557 | P W D A L F G G G N I P A F V L A S L A L A A G I F A M L R L P D L A N S S Y S - S T G F H - I G | SEQ ID NO 42 |
| 559 | P W D A L F G G G N I P A F V L A S L A A L A A G I F A M L R L P N L S - - S N F K S T G F H - I G | SEQ ID NO 43 |
| 558 | P W D A L F G G G N I P A F V L A S L A A L A A G I F A M L R L P N L S - - S N F K S T G F H - I G | SEQ ID NO 44 |
| 548 | P W D A L F G G G N V P A F A L A S V F S L G A G V L A V L K L P K L P - N S Y R S A G F H G F G | SEQ ID NO 45 |
| 545 | P W D A L F G G G N T P A F V L A S V F S L A A G V L A V L K L P K L S - N S Y Q S A G F H G F G | SEQ ID NO 46 |
| 459 | P W D E L F G K G N I P A F A E G A A A G F A F T A A L A A G T I M L P K Q P K T S F R S V S M G - I G G | SEQ ID NO 47 |
| 552 | P W D A L F G G G N V P A F A F A L A S V A S L A A G V I A A V H K L P V L S S D F K S T G F H - F G | SEQ ID NO 48 |
| 561 | P W D A L F G G G N I P A F A F A L L A S V C A L A A G I I A A A L K L P N L S S - S F K S S G F H - F G | SEQ ID NO 49 |
| 564 | P W D A L F G G G N I P A F A F A L A S V C A L A A G V I A T L K L P N L S S - S F K S S G F H - F G | SEQ ID NO 50 |
| 488 | P W D A L Y G G G N I P A F A F A L A S I F S L A A G V L A V L K L P K L S - N S Y Q S A G F H G F G | SEQ ID NO 52 |
| 450 | P W D A L F G K G N I P A F G V A S G F A L I G G I A G V F L L P K I S K R Q F R A V S A G - I G | SEQ ID NO 150 |

| | | |
|---|---|---|
| 594 | | SEQ ID NO 4 |
| 602 | | SEQ ID NO 34 |
| 620 | | SEQ ID NO 36 |
| 607 | | SEQ ID NO 41 |
| 604 | | SEQ ID NO 42 |
| 605 | | SEQ ID NO 43 |
| 604 | | SEQ ID NO 44 |
| 595 | | SEQ ID NO 45 |
| 582 | | SEQ ID NO 46 |
| 507 | H | SEQ ID NO 47 |
| 599 | | SEQ ID NO 48 |
| 608 | | SEQ ID NO 49 |
| 611 | | SEQ ID NO 50 |
| 537 | M L A P K A F C H V A S G H T T N T E P R F P I R L Q | SEQ ID NO 52 |
| 497 | H | SEQ ID NO 150 |

| | | | | | | | | | | | | | | | | | | | | | |
|---|---|---|---|---|---|---|---|---|---|---|---|---|---|---|---|---|---|---|---|---|---|
| 270 | EVETEPSGPLAVLKGFKNLPTGMPSVLLVTGLTWLSWFPFIHLLYDTTDWMGR | SEQ ID NO 53 |
| 268 | EVEAEPTGPLAVLKGFKNLPRGMPSVLLVTGLTWLSWFPFIHLLYDTTDWMGR | SEQ ID NO 54 |
| 268 | EVETEPTGPLAVLKGFKDLPPGMPSVLLVTGLTWLSWFPFIHLLYDTTDWMGR | SEQ ID NO 55 |
| 271 | QVEVEPTGPLAVFKGFKNLPPGMPSVLLVTGLTWLSWFPFIHLLYDTTDWMGR | SEQ ID NO 56 |
| 271 | QVEVEPTGPLAVFKGFKNLPPGMPSVLLVTGLTWLSWFPFIHLLYDTTDWMGR | SEQ ID NO 57 |
| 272 | QVEVEPTGPLAVFKGFKNLPPGMPSVLLVTGLTWLSWFPFIHLLYDTTDWMGR | SEQ ID NO 58 |
| 272 | QVEVEPTGPLAVFKGFRNLPTGMPSVLIVTGLTWLSWFPFILLFDTTDWMGR | SEQ ID NO 59 |
| 286 | PAEPEGTGPLAVLKGFKGMKNLPVGMPSVLIVTGLTWLSWFPFILLFDTTDWMGR | SEQ ID NO 60 |
| 255 | NE-GEASGLLAVFKGFKGMKRNMPPGMPQVLLVTGLTWLSWFPFIHLLFDTTDWMGR | SEQ ID NO 61 |
| 255 | GEDGEPSGPFAVFKGFKGMKNLPPGMPAMFKVLAVTAVTWLSWFPFIHLLFQYNTDWMGR | SEQ ID NO 62 |
| 256 | DEAGESSGPFAVFVDLFKSLRNLPPAMFSVLAVTAVTWLSWFPFIHLLQQYNTDWMGR | SEQ ID NO 63 |
| 283 | SGGGGCAVFVDLFKSLKNLPPAMFSVLAVTAVTWLSWFPFIHLLQQYNTDWMGR | SEQ ID NO 64 |
| 280 | ASGGGACSLFVHLFKSLKNLSPAMFKVLGVLAVTAITTWLAWFPFFQYNTDWMGR | SEQ ID NO 65 |
| 280 | ASGGGACSAFVDLFKSFKNLSPAMFKVLGVLAVTAITTWLAWFPFFQYNTDWMGR | SEQ ID NO 66 |
| 273 | SSGGWSAFGDLFKCLKNLPPAMFSVLAVTAIHTTWLAWFPFFQYNTDWMGR | SEQ ID NO 67 |
| 277 | ASGGACSAFVDLFKCLKNLPPAMFSVLAVTAVTWLAWFPFFQYNTDWMGR | SEQ ID NO 68 |
| 278 | TSGGAFMDLFKSLKNLPPAMFSVLAVTAVTWLSWFPFFQYNTDWMGR | SEQ ID NO 69 |
| 320 | EIYHGDPKGSNAQISAFDEGVRVGSFGLLIVSFGLLIVSVLLGASVTSFLIEPMCRKVG | SEQ ID NO 53 |
| 318 | EIYHGDPKGTNAQISAFNEGVRIGAFGLLLLIVLGFSSFLIEPMCRKVG | SEQ ID NO 54 |
| 318 | EIYHGDPKGSNAQISAFNEAVRVGAAFGLLLLIVVLGFSSFLIEPMCRKVG | SEQ ID NO 55 |
| 321 | EIYHGDPKGTPDEANAFQAGVRAGAFGLLLLIVVLGFSSFLIEPLCKRLG | SEQ ID NO 56 |
| 321 | EIYHGDPKGTPDEANAFQAGVRAGAFGLLLLIVVLGFSSFLIEPLCKRLG | SEQ ID NO 57 |
| 322 | EIYHGDPKGTPAEANAFQEGVRAGAFGLLLLIVVLGFSSFLIEPMCKRLG | SEQ ID NO 58 |
| 322 | FIYHGDPKCTDPQIEAFNQGVRAGAFGLLLLIVVLGFSSFLIEPMCRKVG | SEQ ID NO 59 |
| 336 | EIYHGDPKCTDPQIEAFNQGVRAGAFGLLLLIHVLGFSSFLIHEHIEPMCRKLT | SEQ ID NO 60 |
| 304 | EIYHGRPDGSPTEEVAREFQEGVRQGAFGLLLLNSHVLLGFSSFLHEHIPKLRT | SEQ ID NO 61 |
| 305 | EIYHGRPDGSPEEVAREFQEGVRQGAFGLLLLNSVVLLGFSSFLLIPKLKRLT | SEQ ID NO 62 |
| 306 | EMYHGKPDGSPTEEVANYEQEGVRQGAFGLLLLNSVVLVALGVVSSFVTSFLIPKLKRLT | SEQ ID NO 63 |
| 333 | EIFIGEPQQGTAAKADVYDAGVREGAMGLLFCSVALLGIVSFVTSFLIPKLCRKLT | SEQ ID NO 64 |
| 330 | EIFHGEPQGAGGKADLLYNAGVREGAVGLLFCSVLLLGIVSLGVVSFVTSFLIPKLCRKLT | SEQ ID NO 65 |
| 330 | EIFHGEPQGAGGKADLYNADSYNAGVREGAVGLLFCSISLGVALGVVSFVTSFLIPRLCRKLT | SEQ ID NO 66 |
| 323 | EIYHGDPHGKGAGGKADLLYKADSYNAGVREGAVGLLLCSVALGVVSFVTSLLLIPRLCRKLT | SEQ ID NO 67 |
| 327 | EIFHGEPQGAGGKADLLYKADSYNAGVREGAVGLLLCSVALGVVSFVTSLLLIPRLCRKLT | SEQ ID NO 68 |
| 328 | EIFHGEPQGSGSKADLYEAGVREGAIGLLFCSVALGVVSFFIPRLCRKLT | SEQ ID NO 69 |

| | | | | | | | | | | | | | | | | | | | |
|---|---|---|---|---|---|---|---|---|---|---|---|---|---|---|---|---|---|---|---|
| 467 | H | I | A | L | G | A | G | P | W | D | A | L | F | G | K | G | N | I | P | A F G V A S G F A L I G G V V G V F L L P K I S K R Q F R - - SEQ ID NO 53 |
| 465 | I | I | A | V | G | A | G | P | W | D | A | L | F | G | K | G | N | I | P | A F G V A S G F A L I G G V V G V F L L P K I S K R Q F R - - SEQ ID NO 54 |
| 465 | I | T | A | L | G | A | G | P | W | D | A | L | F | G | K | G | N | I | P | A F G V A S A F A L V G G V V G V F L L P K I S K R R Q F R - - SEQ ID NO 55 |
| 468 | H | I | A | V | G | A | G | P | W | D | D | L | F | G | K | G | N | I | P | A F G M A S A F A L I G G I V G I F L L P K I S R R Q F R - - SEQ ID NO 56 |
| 468 | H | I | A | V | G | A | G | P | W | D | E | L | F | G | K | G | N | I | P | A F G M A S A F A L I G G I V G I F L L P K I S R R Q F R - - SEQ ID NO 57 |
| 469 | H | I | A | V | G | A | G | P | W | D | E | L | F | G | K | G | N | I | P | A F G M A S V F A L I G G V V G I F L L P K I S R R Q F R - - SEQ ID NO 58 |
| 469 | H | I | A | V | G | A | G | P | W | D | E | L | F | G | K | G | N | I | P | A F G L A S G F A L I G G V A G I F L L P K I S K R Q F R - - SEQ ID NO 59 |
| 483 | V | I | A | L | G | A | G | P | W | D | E | L | F | G | E | G | N | I | P | A F A M A S V F A A A A G V V L L P - - K V S V R - - SEQ ID NO 60 |
| 454 | A | I | A | L | G | A | G | P | W | D | E | L | F | G | K | G | N | I | P | A F G A A V F A G V V A G I H M L P K Q P K T S F R - - SEQ ID NO 61 |
| 452 | I | I | A | V | G | S | G | P | W | D | E | L | F | G | K | G | N | I | P | A F G L A A V F A F T A A A G I I M L P K T R G V S N - - A SEQ ID NO 62 |
| 453 | V | I | A | I | G | S | G | P | W | D | E | L | F | G | K | G | N | I | P | A F G I G I C G V L A L T W L L P K T R G V S N - - A SEQ ID NO 63 |
| 481 | V | I | A | L | T | A | G | P | I | D | G | A | F | N | K | G | N | T | P | A L G I G I C A V L A L V L L P K T R G V S N A S A SEQ ID NO 64 |
| 479 | V | I | A | L | S | A | G | P | I | D | G | A | F | N | K | G | N | T | P | A F G K G N A P A V F A L I S A V L A L F L L P K T R G I S H - - A SEQ ID NO 65 |
| 479 | L | I | H | A | L | T | A | G | P | I | D | G | A | F | G | K | G | N | T | P A L G I H G A V F A L I C A V L A L F L I L P R T R G V S N - - A SEQ ID NO 66 |
| 471 | I | I | H | A | L | T | A | G | P | I | D | G | A | F | N | K | G | N | T | P A F G I G A V F A F I C A V L A L I L L P K T R G V S N - - A SEQ ID NO 67 |
| 476 | V | I | A | L | G | A | G | P | I | D | G | A | F | N | K | G | N | T | P | A F G I G A A F A L I C A V L A L I L L P K T R G V S N - - A SEQ ID NO 68 |
| 476 | V | I | A | L | G | A | G | P | I | D | G | A | F | N | K | G | N | T | P | A F G I G A A F A L I C A V L A L I L L P K T R G V S N - - A SEQ ID NO 69 |

| 515 | A V S A G G - H | SEQ ID NO 53 |
| 513 | A V S A G G - H | SEQ ID NO 54 |
| 513 | A V S A G G - H | SEQ ID NO 55 |
| 516 | A V S G G G - H | SEQ ID NO 56 |
| 516 | A V S G G G - H | SEQ ID NO 57 |
| 517 | A V S G G G - H | SEQ ID NO 58 |
| 517 | S V S G G G - H | SEQ ID NO 59 |
| 531 | S V S M G G G H | SEQ ID NO 60 |
| 499 | S V S M A G G H | SEQ ID NO 61 |
| 500 | S V S M G G G H | SEQ ID NO 62 |
| 501 | S V S M G G G H | SEQ ID NO 63 |
| 529 | T V M A G G - H | SEQ ID NO 64 |
| 527 | T V M A S G - G H | SEQ ID NO 65 |
| 529 | T V M A S G - H C | SEQ ID NO 66 |
| 519 | A V V A S G - H | SEQ ID NO 67 |
| 524 | T V M A G G - H | SEQ ID NO 68 |
| 524 | T V M A G G - H | SEQ ID NO 69 |

| | | | | |
|---|---|---|---|---|
| 481 | AVGAATGFIGGIVAILALPRTRIQK------PIPLP | SEQ ID NO 6 |
| 476 | AVAAVSALISGLIAVLAIPRSGAQK------ARSHV | SEQ ID NO 38 |
| 484 | GVAAVAALASGLIAVLFIPRPGGQK------PRSPV | SEQ ID NO 40 |
| 478 | AVAAIAALVSGGIAVFAIPRTGSQK------PRNPV | SEQ ID NO 70 |
| 469 | AIGGLAAFAGGLVAILGIPRSGAQK------PMALP | SEQ ID NO 71 |
| 469 | AVGALAAFAGGVVAILGIPRSGAPK------PRAPP | SEQ ID NO 72 |
| 467 | AVGGLAALAGGLIAILGIPRSGTQK------PRALP | SEQ ID NO 73 |
| 472 | AVAAVAAFASGLVAILAIPRSSADK------SRVHT | SEQ ID NO 74 |
| 471 | VVAALSAFAGGLIAILAIPRTRVEK------PKIFA | SEQ ID NO 75 |
| 472 | VVAALSAFAAGLIAILAIRRPRVDK------SRLHH | SEQ ID NO 76 |
| 466 | AVAAGASFIGGLVAILGLPRARIASSS-RRRGGTHR | SEQ ID NO 77 |
| 465 | AVAAGSSFIGGLVAILGLPRARIASSSSRRRGGTHR | SEQ ID NO 78 |
| 471 | AVAAASFIGGLVAILGLPRARIAS------RRRG--HR | SEQ ID NO 79 |
| 475 | WVAAAASFVGGLVAILGLPRARLGP------KKKTTQR | SEQ ID NO 80 |
| 470 | AVAAVASLASGLVAILAIPRSAAPK------PRAVT | SEQ ID NO 81 |
| 469 | AVAAVAAFASGLVAILAIPRSRAQK------PRALT | SEQ ID NO 82 |
| 482 | AVGAVAAIMSGLLAVLAIPRTGTQK------PQIRV | SEQ ID NO 83 |
| 464 | AVAAGAAFIGGLVAILGLPRARIASSSSRRRGGTNRR | SEQ ID NO 85 |

FIG. 7

Percent Identity

| | 1 | 2 | 3 | 4 | 5 | 6 | 7 | 8 | 9 | 10 | 11 | 12 | 13 | 14 | 15 | |
|---|---|---|---|---|---|---|---|---|---|---|---|---|---|---|---|---|
| 1 | | 72.4 | 72.5 | 72.0 | 71.4 | 69.2 | 69.2 | 62.3 | 63.1 | 54.9 | 72.1 | 72.7 | 75.2 | 67.6 | 56.5 | SEQ ID NO 4 |
| 2 | 34.4 | | 95.2 | 74.7 | 73.9 | 71.4 | 71.5 | 65.7 | 67.4 | 57.7 | 75.6 | 76.0 | 77.2 | 71.3 | 59.3 | SEQ ID NO 34 |
| 3 | 34.3 | 5.0 | | 75.2 | 74.2 | 72.4 | 72.4 | 64.6 | 66.7 | 56.8 | 75.6 | 77.0 | 77.9 | 70.4 | 59.4 | SEQ ID NO 36 |
| 4 | 35.0 | 30.8 | 30.2 | | 73.2 | 72.5 | 72.5 | 65.0 | 67.1 | 56.3 | 73.6 | 77.8 | 77.9 | 71.1 | 59.4 | SEQ ID NO 41 |
| 5 | 36.0 | 32.1 | 31.7 | 33.2 | | 76.1 | 76.0 | 66.0 | 68.1 | 55.3 | 74.5 | 74.0 | 74.9 | 72.2 | 58.5 | SEQ ID NO 42 |
| 6 | 39.7 | 36.1 | 34.3 | 34.2 | 28.8 | | 97.8 | 63.8 | 67.1 | 55.8 | 75.7 | 73.6 | 74.3 | 70.2 | 58.6 | SEQ ID NO 43 |
| 7 | 39.7 | 35.8 | 34.3 | 34.2 | 29.0 | 2.2 | | 64.0 | 67.0 | 55.6 | 76.2 | 73.7 | 74.5 | 70.4 | 58.6 | SEQ ID NO 44 |
| 8 | 52.0 | 45.6 | 47.6 | 46.9 | 45.2 | 49.1 | 48.8 | | 86.9 | 55.6 | 65.3 | 66.1 | 66.4 | 90.6 | 59.7 | SEQ ID NO 45 |
| 9 | 50.4 | 42.6 | 43.9 | 43.2 | 41.4 | 43.1 | 43.4 | 14.4 | | 56.4 | 66.8 | 65.8 | 66.1 | 93.1 | 59.1 | SEQ ID NO 46 |
| 10 | 67.7 | 61.4 | 63.4 | 64.4 | 66.8 | 65.7 | 66.2 | 66.1 | 64.2 | | 55.8 | 54.8 | 55.6 | 58.0 | 69.9 | SEQ ID NO 47 |
| 11 | 35.0 | 29.5 | 29.6 | 32.5 | 31.1 | 29.5 | 28.7 | 46.4 | 43.7 | 65.7 | | 74.1 | 74.7 | 70.4 | 59.6 | SEQ ID NO 48 |
| 12 | 34.0 | 28.9 | 27.6 | 26.4 | 31.9 | 32.6 | 32.3 | 45.0 | 45.5 | 68.0 | 31.8 | | 91.4 | 70.8 | 59.0 | SEQ ID NO 49 |
| 13 | 30.1 | 27.3 | 26.2 | 26.2 | 30.6 | 31.5 | 31.3 | 44.4 | 44.9 | 66.0 | 31.0 | 9.1 | | 70.7 | 60.5 | SEQ ID NO 50 |
| 14 | 42.4 | 36.2 | 37.7 | 36.6 | 34.8 | 37.9 | 37.6 | 10.1 | 7.3 | 60.8 | 37.6 | 36.9 | 37.1 | | 59.4 | SEQ ID NO 52 |
| 15 | 64.1 | 58.0 | 57.7 | 57.8 | 59.7 | 59.5 | 59.5 | 57.1 | 58.3 | 38.4 | 57.4 | 58.7 | 55.6 | 57.8 | | SEQ ID NO 150 |
| | 1 | 2 | 3 | 4 | 5 | 6 | 7 | 8 | 9 | 10 | 11 | 12 | 13 | 14 | 15 | |

FIG. 8

Percent Identity

| | 1 | 2 | 3 | 4 | 5 | 6 | 7 | 8 | 9 | 10 | 11 | 12 | 13 | 14 | 15 | 16 | 17 | | |
|---|---|---|---|---|---|---|---|---|---|---|---|---|---|---|---|---|---|---|---|
| 1 | ■ | 95.0 | 93.6 | 81.7 | 81.5 | 81.6 | 83.3 | 85.2 | 71.3 | 68.6 | 68.0 | 53.6 | 54.5 | 52.2 | 54.7 | 54.5 | 55.2 | 1 | SEQ ID NO 53 |
| 2 | 5.2 | ■ | 92.8 | 83.2 | 83.0 | 83.0 | 84.4 | 86.1 | 71.1 | 67.8 | 67.3 | 53.5 | 53.7 | 52.2 | 55.0 | 55.2 | 54.7 | 2 | SEQ ID NO 54 |
| 3 | 6.7 | 7.6 | ■ | 82.0 | 81.9 | 81.9 | 82.6 | 84.0 | 70.9 | 68.1 | 68.2 | 54.2 | 54.6 | 52.5 | 54.9 | 54.9 | 55.2 | 3 | SEQ ID NO 55 |
| 4 | 21.0 | 19.0 | 20.6 | ■ | 99.2 | 98.9 | 95.4 | 81.6 | 70.1 | 69.0 | 68.6 | 53.5 | 53.3 | 52.0 | 53.6 | 54.0 | 53.9 | 4 | SEQ ID NO 56 |
| 5 | 21.2 | 19.3 | 20.8 | 0.8 | ■ | 98.5 | 95.0 | 81.6 | 70.1 | 68.8 | 68.4 | 53.1 | 52.9 | 51.7 | 53.6 | 53.6 | 53.5 | 5 | SEQ ID NO 57 |
| 6 | 21.2 | 19.3 | 20.8 | 1.2 | 1.5 | ■ | 95.4 | 81.5 | 70.3 | 69.0 | 68.6 | 53.4 | 53.3 | 52.0 | 53.5 | 54.1 | 53.8 | 6 | SEQ ID NO 58 |
| 7 | 18.9 | 17.5 | 19.8 | 4.8 | 5.2 | 4.7 | ■ | 82.6 | 71.3 | 69.6 | 68.6 | 53.2 | 53.5 | 52.2 | 52.9 | 54.3 | 53.4 | 7 | SEQ ID NO 59 |
| 8 | 16.5 | 15.4 | 18.1 | 21.2 | 21.2 | 21.4 | 19.9 | ■ | 71.4 | 70.0 | 69.6 | 52.4 | 52.5 | 50.9 | 52.7 | 52.9 | 52.8 | 8 | SEQ ID NO 60 |
| 9 | 36.1 | 36.5 | 36.9 | 38.1 | 38.1 | 37.8 | 36.1 | 36.1 | ■ | 81.1 | 70.5 | 51.9 | 54.0 | 52.5 | 52.4 | 54.7 | 54.3 | 9 | SEQ ID NO 61 |
| 10 | 40.6 | 42.0 | 41.4 | 40.0 | 40.3 | 40.0 | 39.0 | 38.2 | 21.9 | ■ | 82.5 | 53.5 | 54.1 | 52.8 | 54.6 | 54.2 | 55.3 | 10 | SEQ ID NO 62 |
| 11 | 41.5 | 42.9 | 41.3 | 40.5 | 40.9 | 40.5 | 38.9 | 37.5 | 20.0 | 6.6 | ■ | 53.3 | 53.7 | 51.8 | 53.8 | 54.4 | 54.7 | 11 | SEQ ID NO 63 |
| 12 | 70.7 | 70.9 | 69.3 | 71.0 | 71.9 | 71.2 | 71.7 | 73.7 | 74.9 | 71.1 | 71.5 | ■ | 77.9 | 73.1 | 81.5 | 75.7 | 76.6 | 12 | SEQ ID NO 64 |
| 13 | 68.6 | 70.5 | 68.4 | 71.4 | 72.4 | 71.4 | 71.0 | 73.4 | 69.8 | 69.6 | 70.6 | 26.2 | ■ | 89.9 | 76.0 | 89.8 | 89.4 | 13 | SEQ ID NO 65 |
| 14 | 74.1 | 74.1 | 73.3 | 74.6 | 75.6 | 74.6 | 74.1 | 77.6 | 73.5 | 72.8 | 75.2 | 33.4 | 10.9 | ■ | 73.7 | 85.4 | 85.8 | 14 | SEQ ID NO 66 |
| 15 | 68.2 | 67.5 | 67.7 | 70.7 | 70.7 | 71.0 | 72.4 | 72.9 | 73.7 | 68.4 | 70.3 | 21.3 | 29.0 | 32.5 | ■ | 75.6 | 75.7 | 15 | SEQ ID NO 67 |
| 16 | 68.6 | 67.0 | 67.6 | 69.8 | 70.7 | 69.5 | 69.1 | 72.5 | 68.1 | 69.3 | 68.9 | 29.4 | 11.0 | 16.3 | 29.5 | ■ | 88.0 | 16 | SEQ ID NO 68 |
| 17 | 67.0 | 68.1 | 67.0 | 70.0 | 70.9 | 70.3 | 71.2 | 72.7 | 69.0 | 66.8 | 68.2 | 28.1 | 11.5 | 15.8 | 29.4 | 13.1 | ■ | 17 | SEQ ID NO 69 |
| | 1 | 2 | 3 | 4 | 5 | 6 | 7 | 8 | 9 | 10 | 11 | 12 | 13 | 14 | 15 | 16 | 17 | | |

FIG. 9

Percent Identity

| | 1 | 2 | 3 | 4 | 5 | 6 | 7 | 8 | 9 | 10 | 11 | 12 | 13 | 14 | 15 | 16 | 17 | 18 | | |
|---|---|---|---|---|---|---|---|---|---|---|---|---|---|---|---|---|---|---|---|---|
| 1 | ■ | 68.3 | 66.3 | 66.5 | 72.4 | 72.8 | 71.8 | 70.1 | 69.8 | 69.3 | 61.9 | 61.9 | 63.1 | 61.7 | 72.8 | 74.4 | 69.3 | 63.2 | 1 | SEQ ID NO 6 |
| 2 | 41.1 | ■ | 80.8 | 77.4 | 71.8 | 71.8 | 71.5 | 72.2 | 70.9 | 71.0 | 64.2 | 64.5 | 64.4 | 62.5 | 73.8 | 74.6 | 84.6 | 64.9 | 2 | SEQ ID NO 38 |
| 3 | 44.5 | 22.2 | ■ | 81.1 | 72.8 | 73.8 | 73.3 | 73.2 | 70.9 | 69.0 | 63.9 | 63.6 | 65.6 | 62.3 | 72.4 | 73.8 | 78.5 | 66.3 | 3 | SEQ ID NO 40 |
| 4 | 44.2 | 27.0 | 21.9 | ■ | 73.0 | 73.8 | 73.5 | 71.3 | 70.3 | 66.5 | 64.7 | 63.8 | 63.7 | 61.9 | 72.6 | 72.8 | 78.7 | 65.2 | 4 | SEQ ID NO 70 |
| 5 | 34.5 | 35.4 | 33.7 | 33.5 | ■ | 94.4 | 92.5 | 74.8 | 71.9 | 68.8 | 64.6 | 64.0 | 65.2 | 62.7 | 77.9 | 78.9 | 72.0 | 66.0 | 5 | SEQ ID NO 71 |
| 6 | 33.9 | 35.4 | 32.2 | 32.3 | 5.9 | ■ | 92.7 | 76.7 | 72.1 | 70.8 | 66.0 | 65.4 | 66.4 | 63.5 | 78.9 | 79.1 | 72.8 | 67.4 | 6 | SEQ ID NO 72 |
| 7 | 35.3 | 35.9 | 33.0 | 32.7 | 7.9 | 7.6 | ■ | 75.8 | 72.6 | 69.9 | 65.7 | 65.3 | 66.3 | 63.0 | 77.8 | 77.8 | 72.9 | 67.3 | 7 | SEQ ID NO 73 |
| 8 | 38.1 | 34.8 | 33.2 | 36.1 | 30.7 | 28.0 | 29.3 | ■ | 73.5 | 73.3 | 67.3 | 66.6 | 66.4 | 65.0 | 77.1 | 80.3 | 71.5 | 68.0 | 8 | SEQ ID NO 74 |
| 9 | 38.5 | 36.8 | 36.7 | 37.8 | 35.2 | 34.9 | 34.1 | 32.7 | ■ | 71.9 | 63.9 | 64.2 | 65.7 | 64.5 | 73.7 | 76.6 | 70.9 | 66.1 | 9 | SEQ ID NO 75 |
| 10 | 39.4 | 36.7 | 39.9 | 44.2 | 40.2 | 36.9 | 38.4 | 33.0 | 35.2 | ■ | 63.4 | 63.5 | 64.1 | 62.1 | 73.0 | 73.6 | 67.1 | 64.9 | 10 | SEQ ID NO 76 |
| 11 | 52.7 | 48.4 | 48.9 | 47.4 | 47.7 | 45.0 | 45.7 | 42.9 | 48.9 | 50.0 | ■ | 96.2 | 90.1 | 83.1 | 65.7 | 67.3 | 63.4 | 92.8 | 11 | SEQ ID NO 77 |
| 12 | 52.9 | 47.8 | 49.4 | 49.1 | 48.8 | 46.2 | 46.4 | 44.1 | 48.3 | 49.7 | 3.9 | ■ | 90.1 | 83.7 | 65.1 | 67.1 | 62.3 | 92.8 | 12 | SEQ ID NO 78 |
| 13 | 50.4 | 48.0 | 45.9 | 49.3 | 46.6 | 44.4 | 44.7 | 44.4 | 45.6 | 48.5 | 10.6 | 10.6 | ■ | 85.2 | 66.0 | 66.4 | 64.0 | 93.7 | 13 | SEQ ID NO 79 |
| 14 | 53.1 | 51.6 | 51.9 | 52.7 | 51.2 | 49.6 | 50.7 | 47.0 | 47.9 | 52.3 | 19.2 | 18.5 | 16.5 | ■ | 64.0 | 65.0 | 62.8 | 84.6 | 14 | SEQ ID NO 80 |
| 15 | 33.8 | 32.2 | 34.4 | 34.1 | 26.2 | 24.8 | 26.3 | 27.4 | 32.4 | 33.4 | 45.6 | 46.8 | 45.0 | 48.7 | ■ | 81.3 | 73.2 | 66.3 | 15 | SEQ ID NO 81 |
| 16 | 31.4 | 31.0 | 32.2 | 33.8 | 24.8 | 24.5 | 26.3 | 22.9 | 28.1 | 32.5 | 42.9 | 43.2 | 44.4 | 47.0 | 21.5 | ■ | 73.6 | 68.3 | 16 | SEQ ID NO 82 |
| 17 | 39.4 | 17.3 | 25.3 | 25.1 | 35.1 | 33.8 | 33.7 | 35.8 | 36.8 | 43.1 | 49.9 | 52.1 | 48.7 | 51.0 | 33.2 | 32.6 | ■ | 64.7 | 17 | SEQ ID NO 83 |
| 18 | 50.2 | 47.2 | 44.7 | 46.5 | 45.2 | 42.6 | 42.8 | 41.7 | 44.9 | 47.2 | 7.6 | 7.6 | 6.6 | 17.2 | 44.7 | 41.2 | 47.5 | ■ | 18 | SEQ ID NO 85 |
| | 1 | 2 | 3 | 4 | 5 | 6 | 7 | 8 | 9 | 10 | 11 | 12 | 13 | 14 | 15 | 16 | 17 | 18 | | |

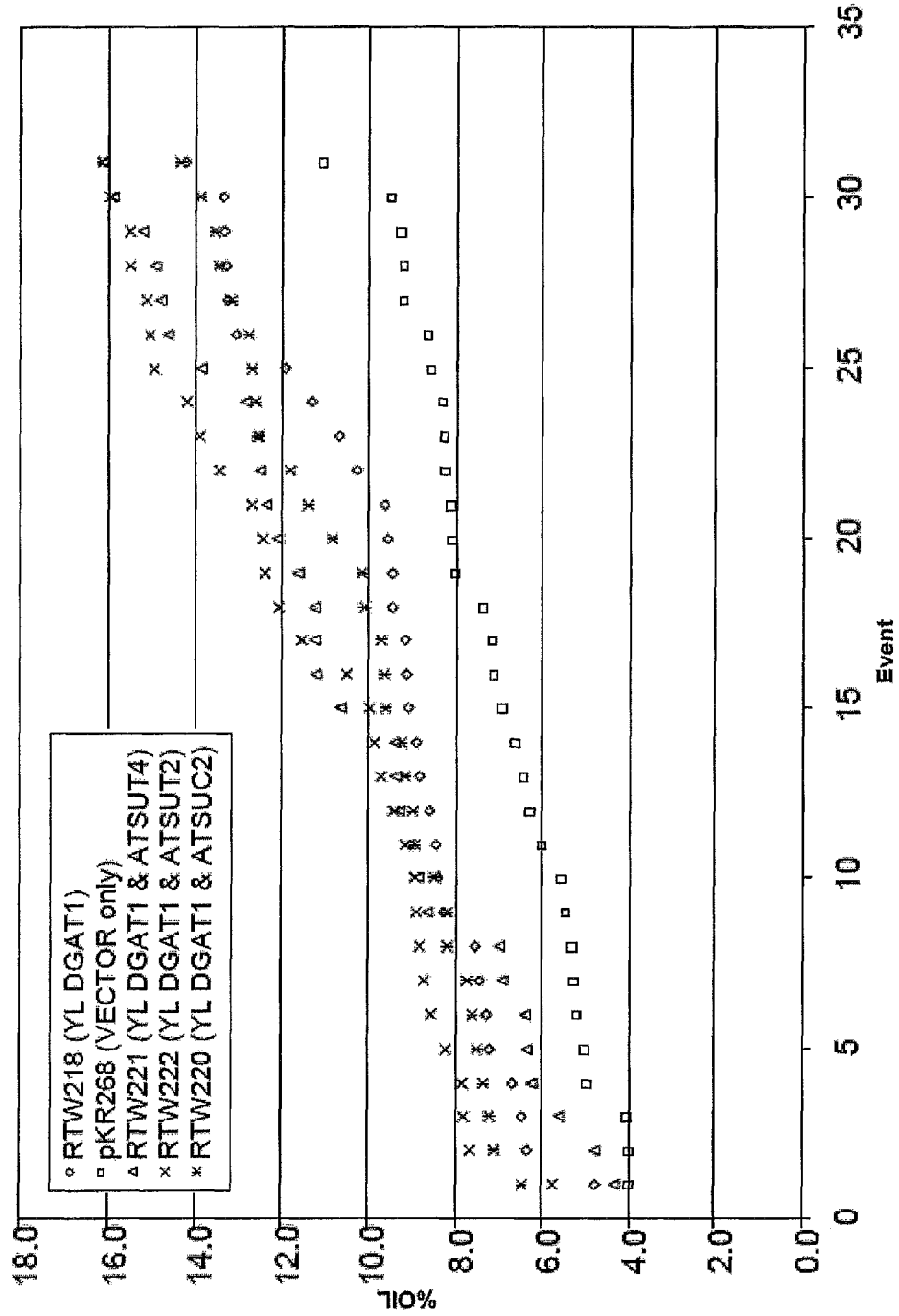

SUCROSE TRANSPORTER GENES FOR INCREASING PLANT SEED LIPIDS

CROSS-REFERENCE TO RELATED APPLICATIONS

This Application claims the benefit of U.S. Provisional Application 61/263,660, filed Nov. 23, 2009, herein incorporated by reference it its entirety.

FIELD OF THE INVENTION

This invention is in the field of biotechnology; in particular, this pertains to polynucleotide sequences encoding SUT2 or SUT4 sucrose transporters and the use of these disaccharide transporters for increased seed lipid production in plants.

REFERENCE TO A SEQUENCE LISTING SUBMITTED AS A TEXT FILE VIA EFS-WEB

The official copy of the sequence listing is submitted concurrently with the specification as a text file via EFS-Web, in compliance with the American Standard Code for Information interchange (ASCII), with a file name of 395696SEQLIST.txt, a creation date of Oct. 28, 2010 and a size of 976 Kb. The sequence listing filed via EFS-Web is part of the specification and is hereby incorporated in its entirety by reference herein

BACKGROUND OF THE INVENTION

Plant lipids have a variety of industrial and nutritional uses and are central to plant membrane function and climatic adaptation. The primary storage reserve of lipids in eukaryotic cells is in the form of triacylglycerols (TAGs).

TAG is the primary component of vegetable oil in plants and is used by the seed as a stored form of energy to be used during seed germination. The quality and content of plant oil can be altered by various methods by impinging on the enzymes involved directly or indirectly in TAG biosynthesis.

Most free fatty acids become esterified to coenzyme A (CoA) to yield acyl-CoAs. These molecules are then substrates for glycerolipid synthesis in the endoplasmic reticulum of the cell where phosphatidic acid and diacylglycerol (DAG) are produced. Either of these metabolic intermediates may be directed to membrane phospholipids phosphatidyl glycerol, phosphatidylethanotamine, phosphatidylcholine) or DAG may be directed to form triacylglycerols (TAGs), the primary storage reserve of lipids in eukaryotic cells.

Sucrose is the major product of photosynthesis in higher plants and is transported from source to sink tissues through the phloem. It is also the major storage form of soluble carbon in sink tissues, and therefore also serves as a long-term energy source. Sucrose transporters (SUTs) play a major role in the photoassimilate accumulation in the sink tissues. The SUTs have been categorized into three major subfamilies: Type I (SUT1), Type II (SUT2) and Type III (SUT4). (Kuhn, *Plant biol* (2003) 5: 215-232; Lim et al., *Physiologia Plantarum* (2006) 16: 572-584). Others have characterized sucrose transporters as high affinity/low capacity, low affinity/high capacity, and medium affinity/high capacity transporters.

Altering the expression level of sucrose transporters can be expected to have effects on the accumulation of photosynthetic assimilates in the sink tissues. Overexpression of a heterologous sucrose transporter has been shown to increase sugar content in sink tissues such as potato tubers, but does not lead to change in starch content or tuber morphology (Leggewie et al. *Planta* (2003) 217: 158-167). Tissue specific overexpression of heterologous sucrose transporters in storage parenchyma cells of pea cotyledons also increases sucrose influx into these cells, and increases the growth rates of pea cotyledons but does not lead to an increase in dry weight of fully developed cotyledons (Rosche et al., *Plant Journal* (2002), 30(2): 165-175).

SUMMARY OF THE INVENTION

Methods and compositions are provided which modulate sucrose transport in a plant, plant cell or seed. Compositions are provided which comprise plants, plant cells and plant seeds having an increased oil content. Such compositions employ at least a first and a second polynucleotide. The first polynucleotide when expressed results in increased oil in said plant and the second polynucleotide encodes a sucrose transporter polypeptide. Various methods of use of such plants, plant cells and seeds are provided.

Further provided are methods which further increase oil content in a high oil plant seed, as well as, methods of evaluating oil content in a plant seed.

Additional compositions include polynucleotides and polypeptides encoding sucrose transporters and active variants and fragments thereof. Plants, plant cells, and seeds comprising these sucrose transporters are further provided, as well as, various methods of use.

BRIEF DESCRIPTION OF THE DRAWINGS AND SEQUENCE LISTINGS

The invention can be more fully understood from the following detailed description and the accompanying drawings and Sequence Listing which form a part of this application. The Sequence Listing contains the one letter code for nucleotide sequence characters and the three letter codes for amino acids as defined in conformity with the IUPAC-IUBMB standards described in Nucleic Acids Research 13:3021-3030 (1985) and in the Biochemical Journal 219 (No. 2): 345-373 (1984), which are herein incorporated by reference in their entirety. The symbols and format used for nucleotide and amino acid sequence data comply with the rules set forth in 37 C.F.R. § 1.822.

Figure 4A:
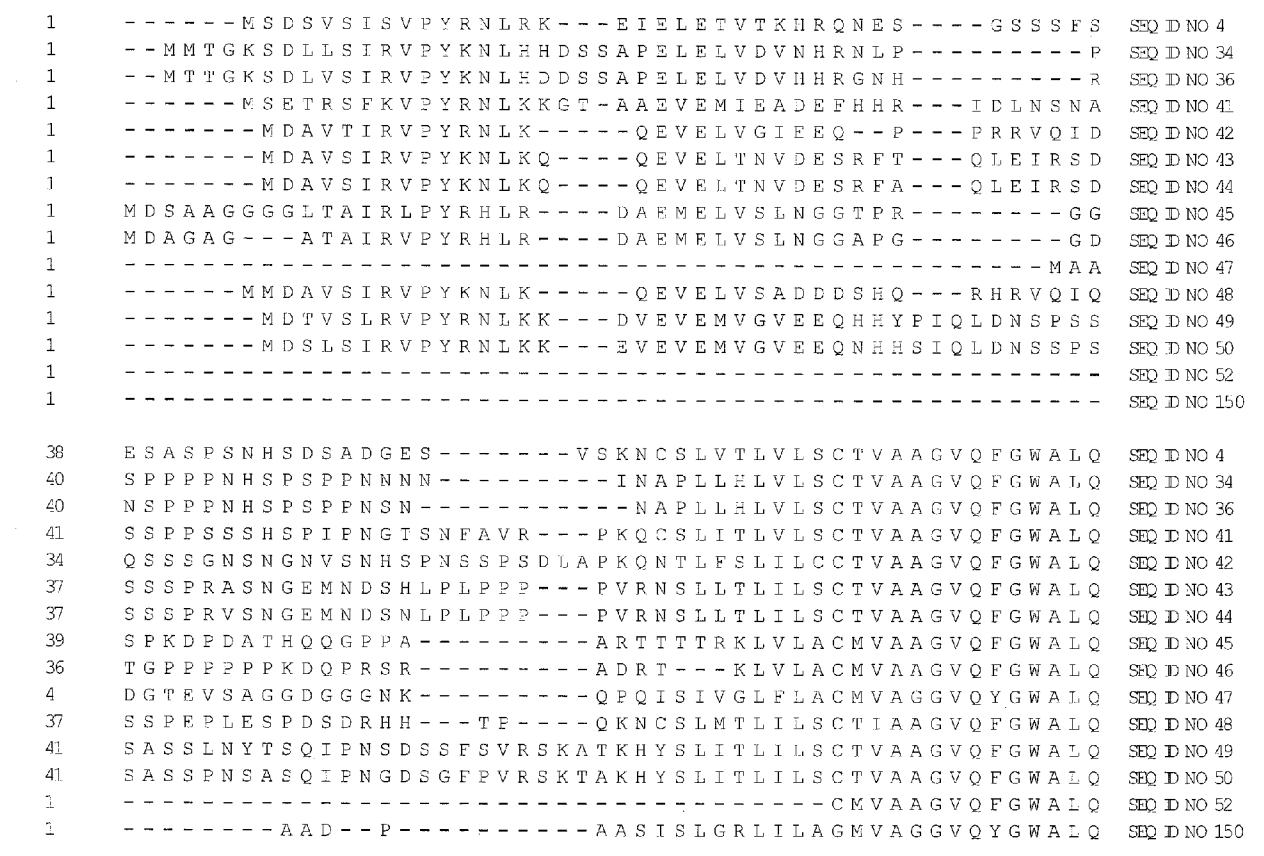
Figure 4B:
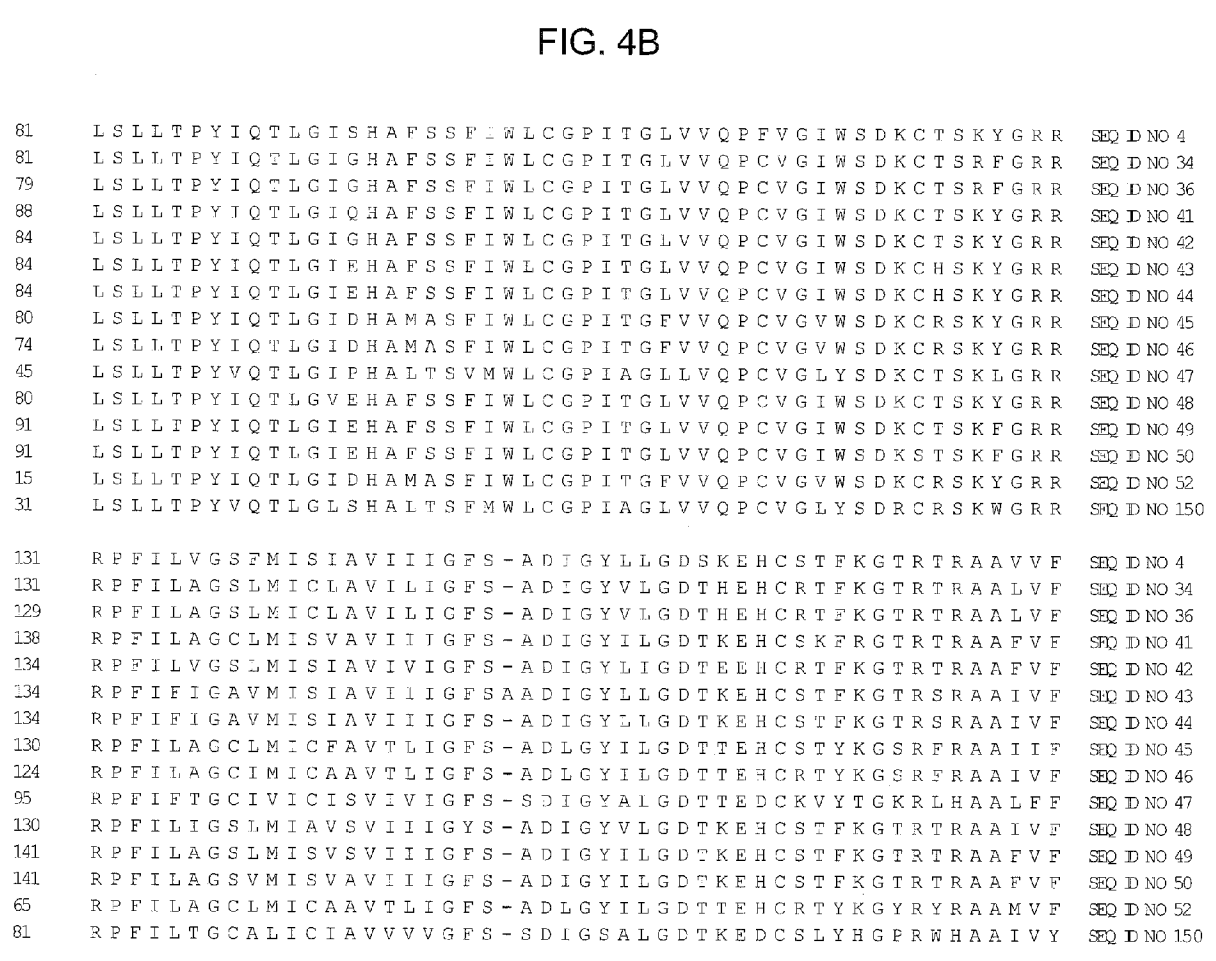
Figure 4C:
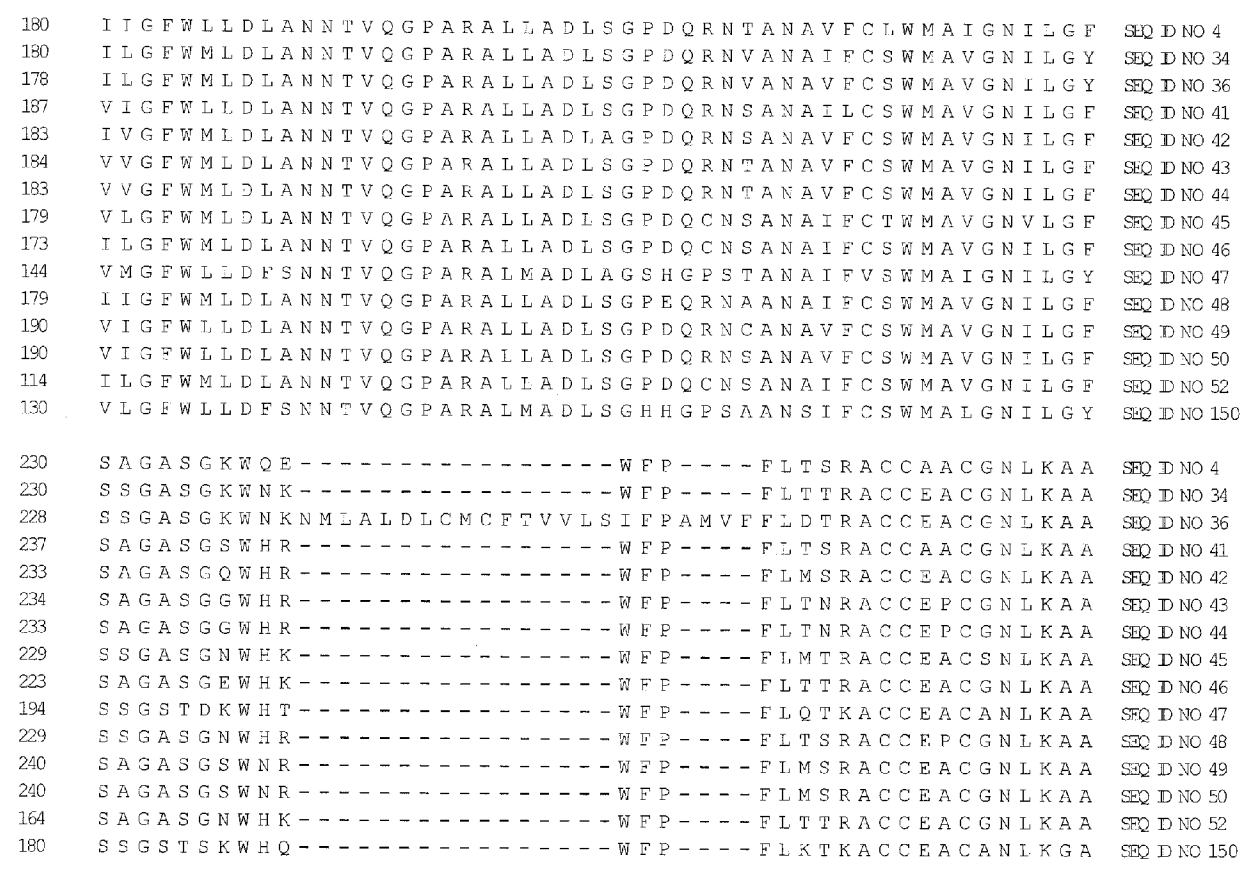
Figure 4F:
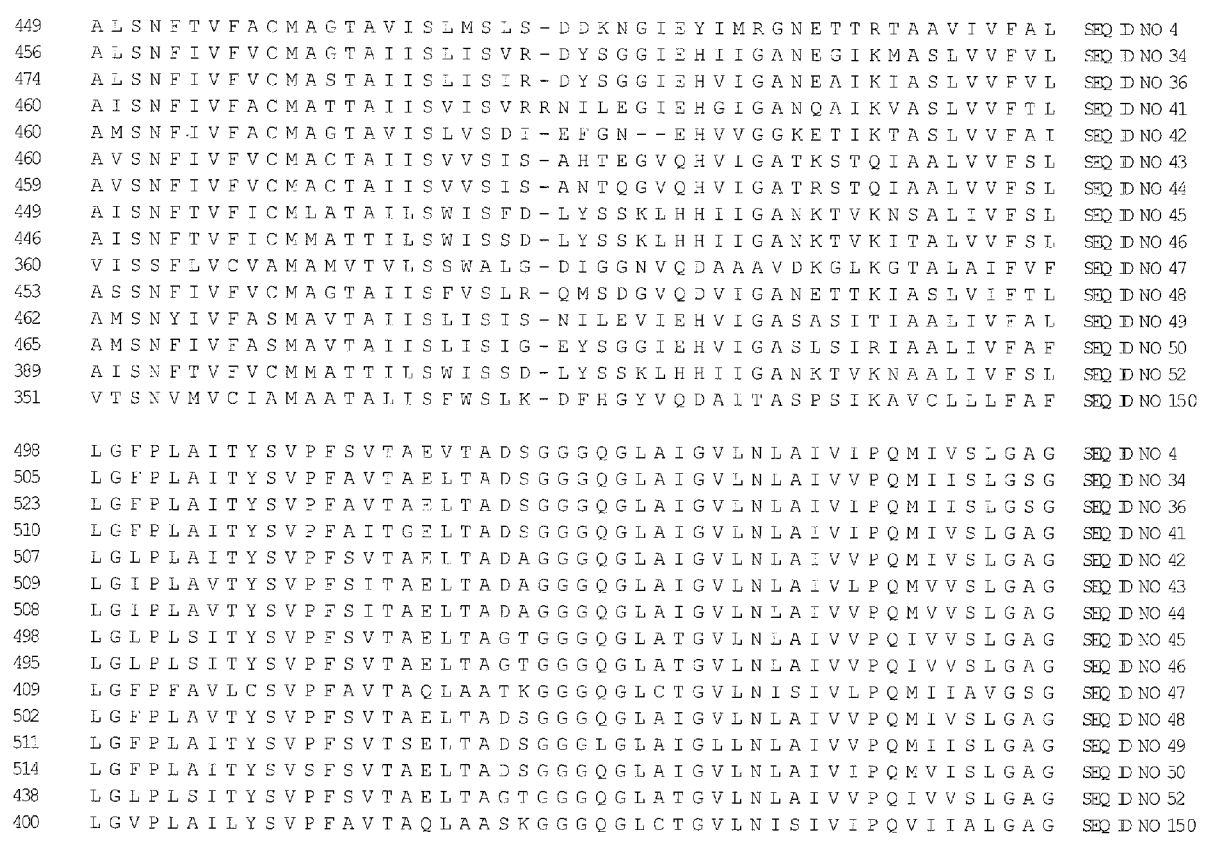

FIG. 4A-G presents an alignment of the amino acid sequences set forth in SEQ ID NOs: 4, 34, 36, 41-50, 52, and 150 of the SUT2 subfamily.

Figure 5A:
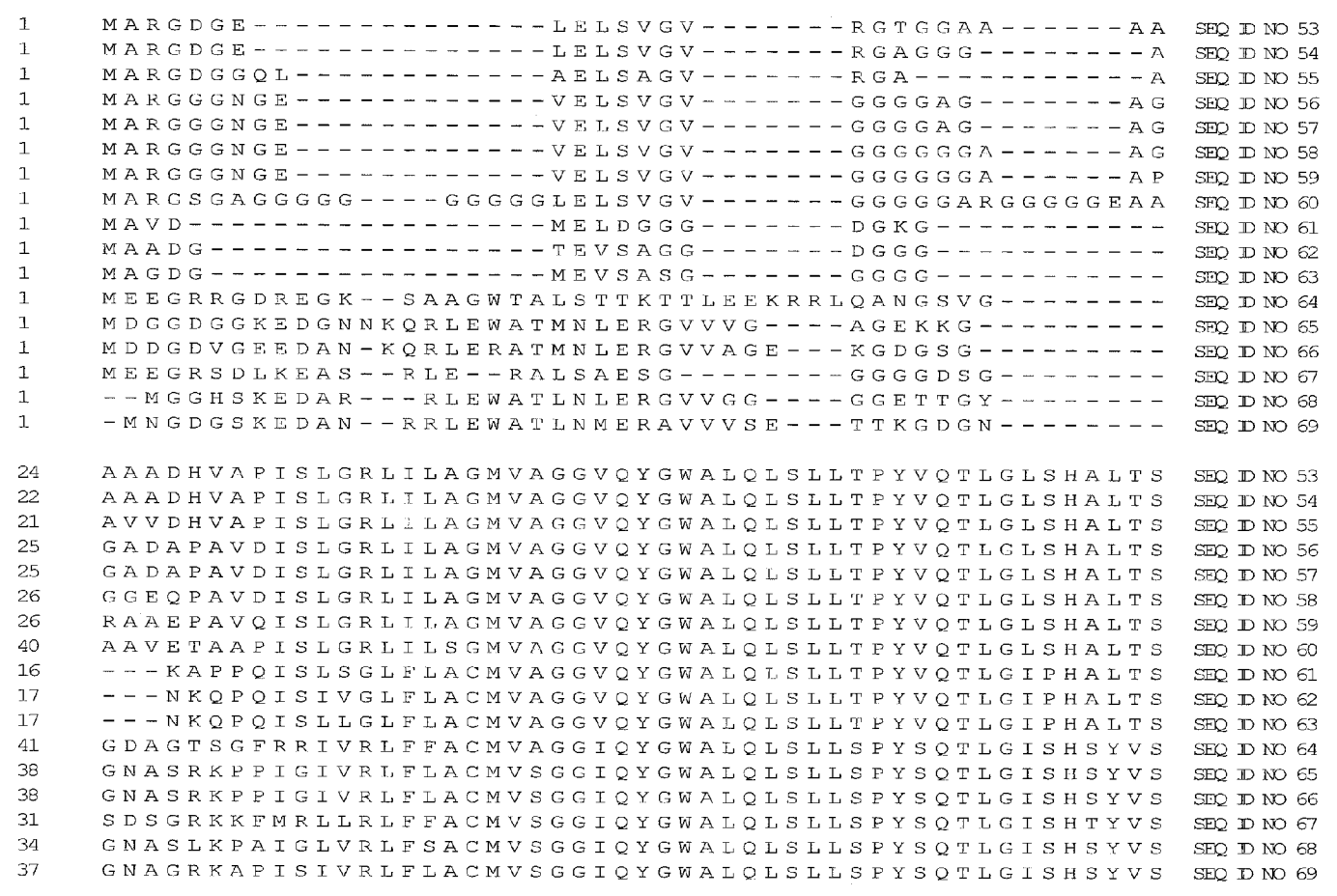
Figure 5B:
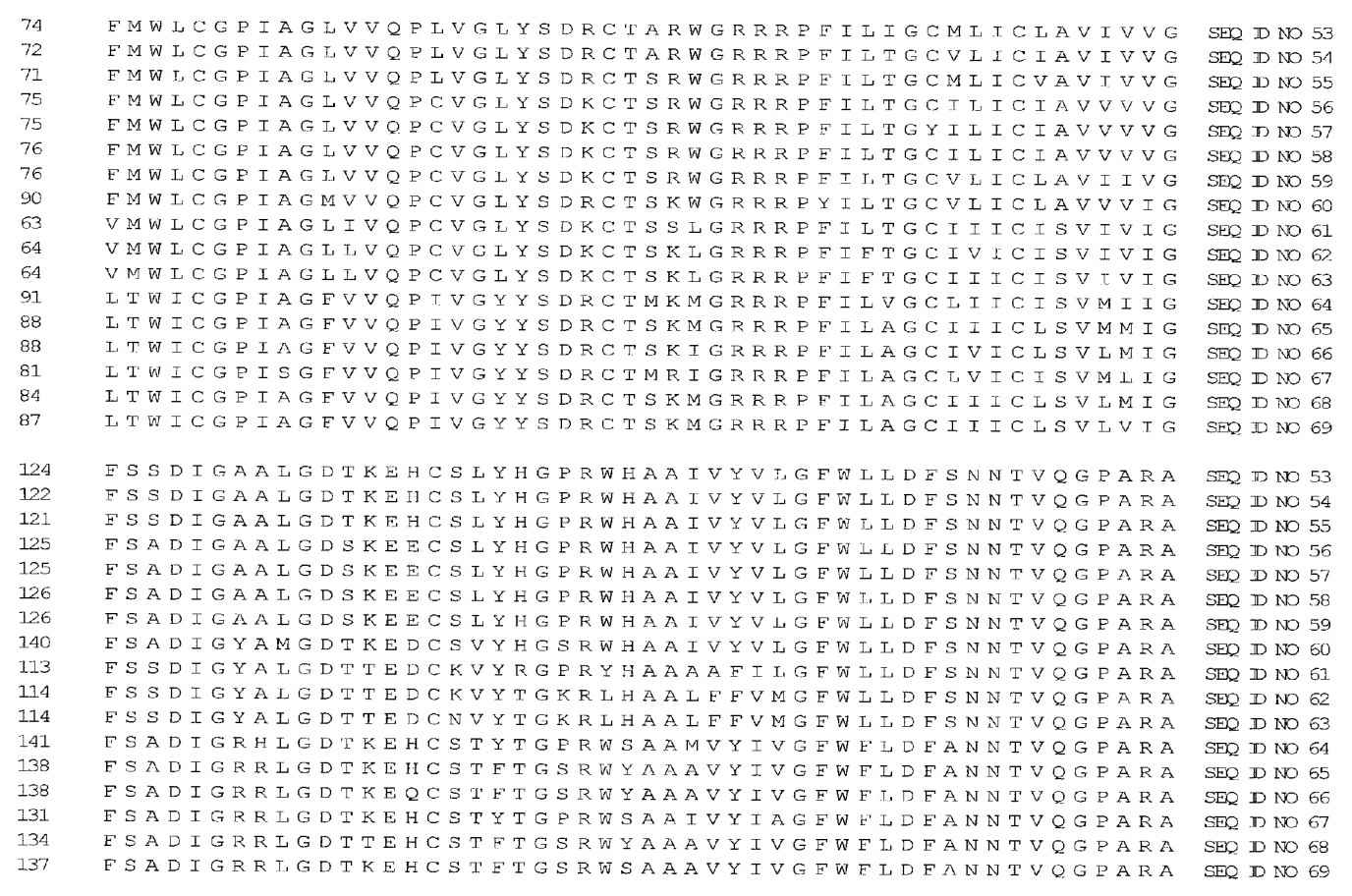
Figure 5C:
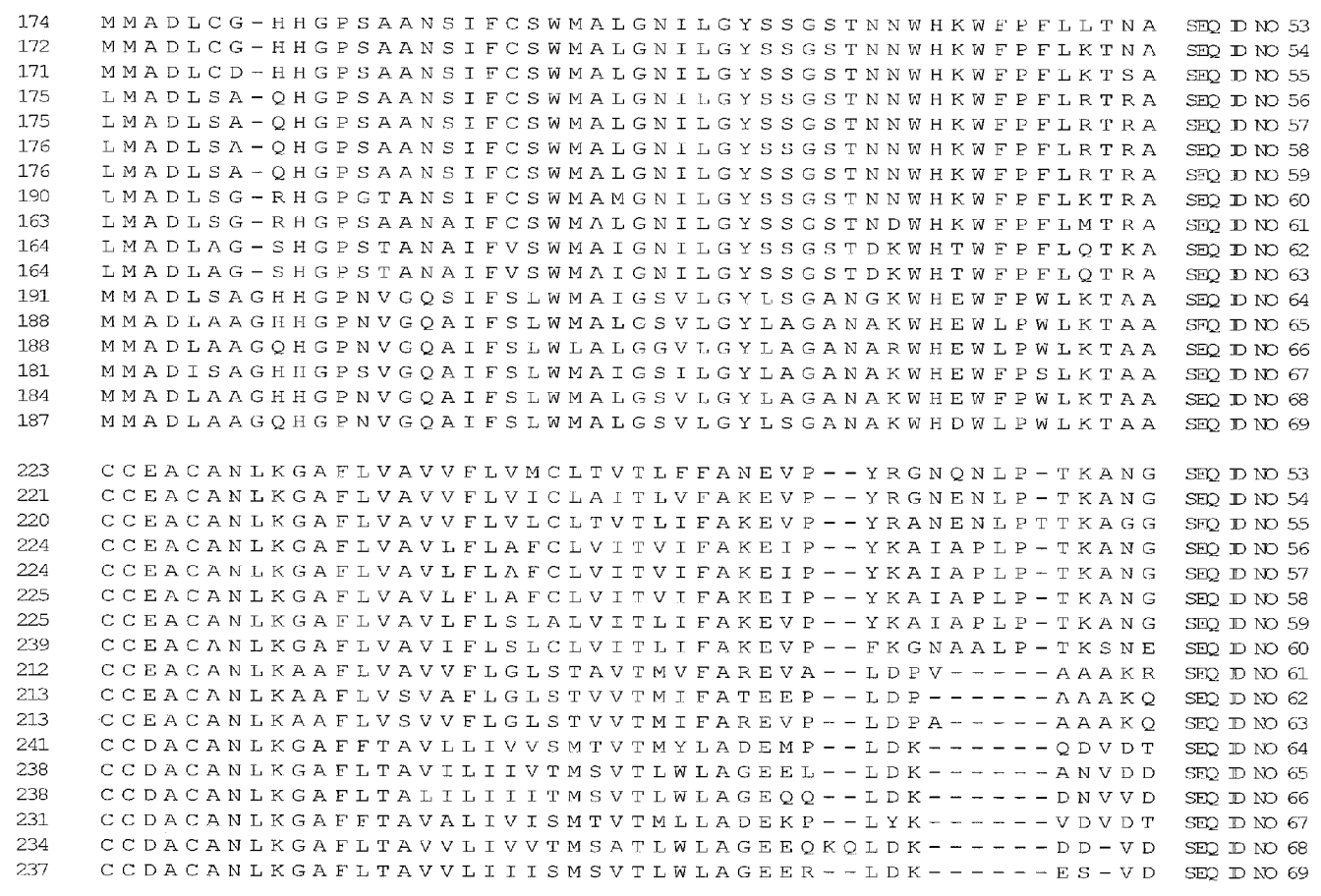
Figure 5E:
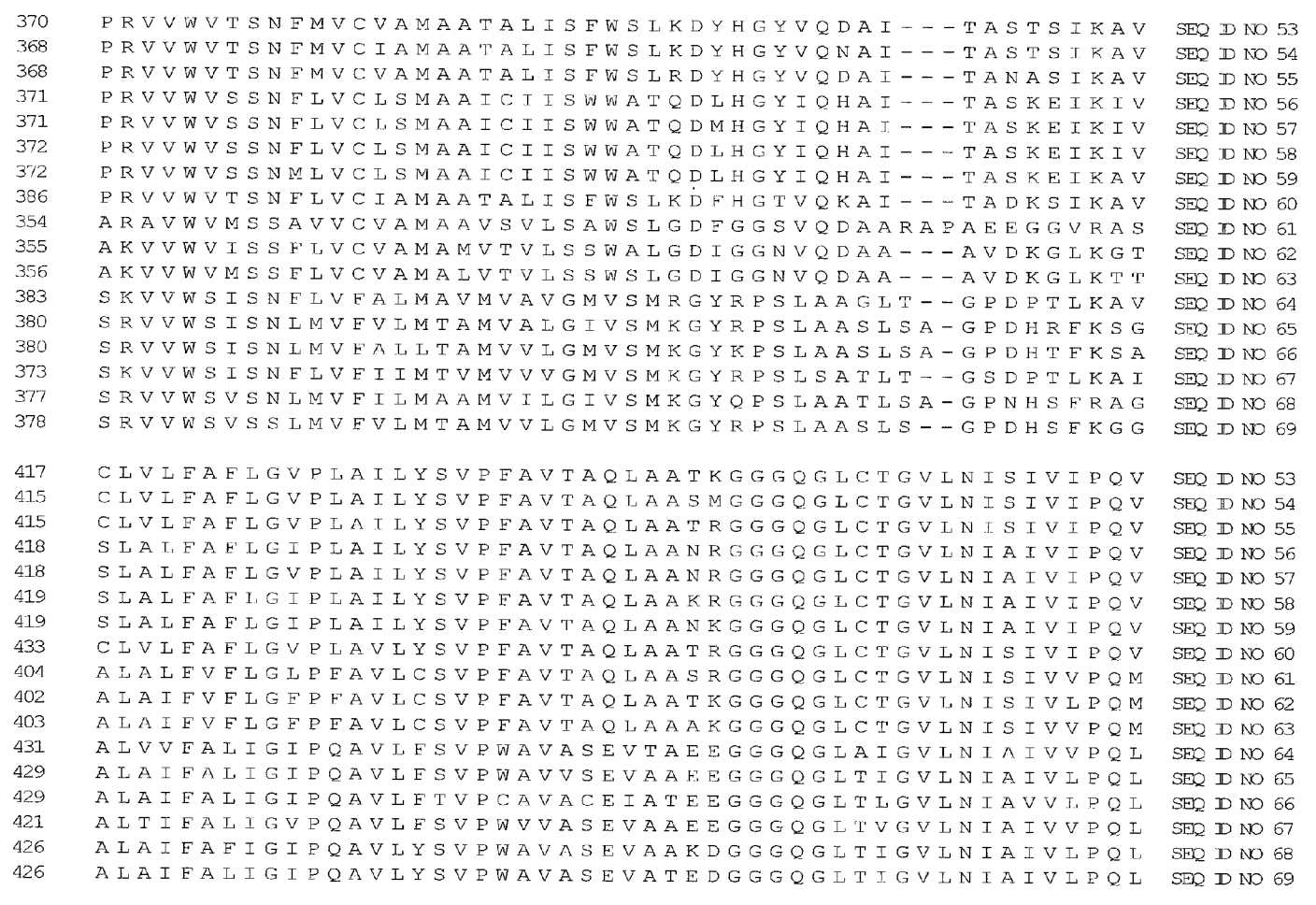

FIG. 5A-F presents an alignment of the amino acid sequences set forth in SEQ ID NOs: 53-69 of the SUT2 subfamily.

Figure 6A:
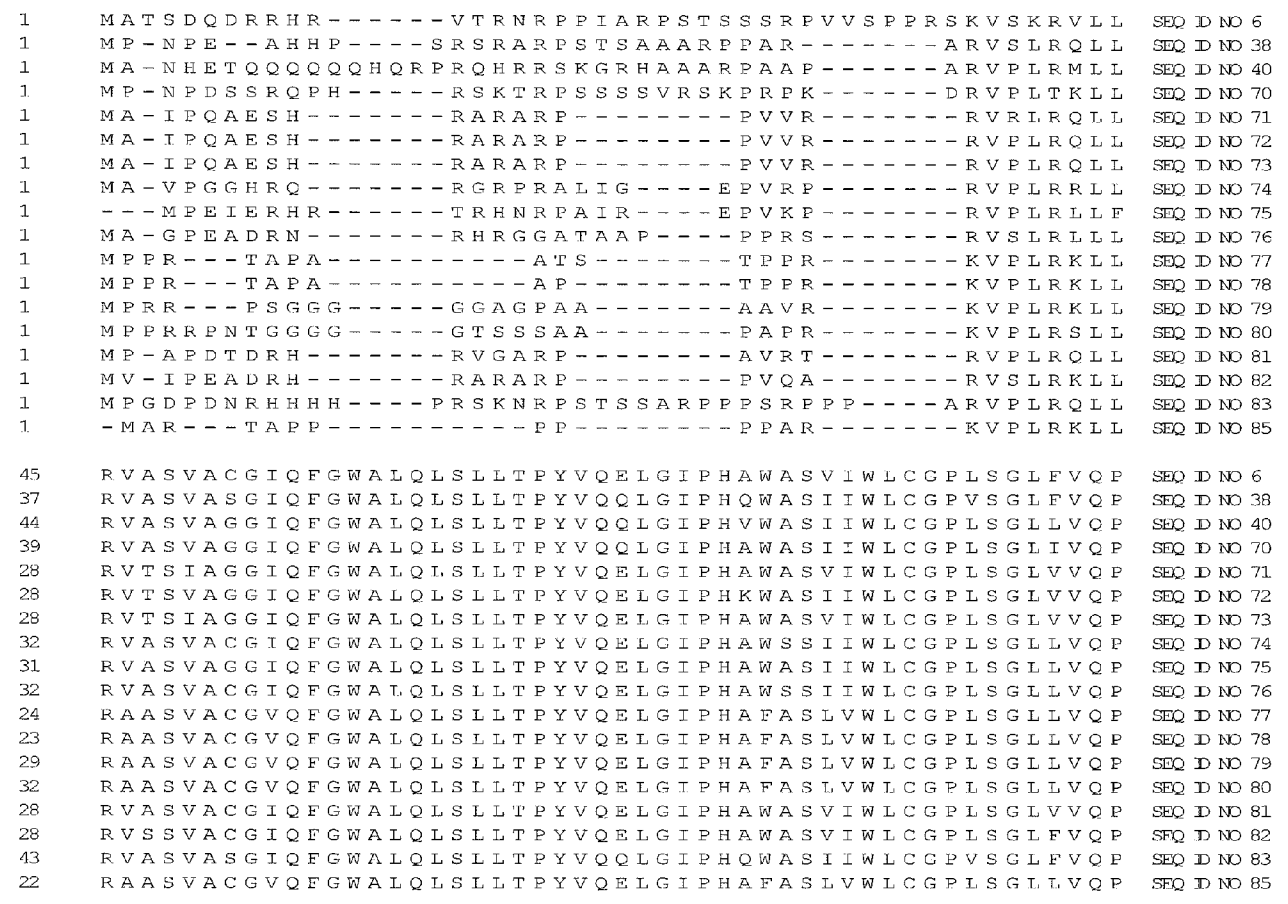
Figure 6B:
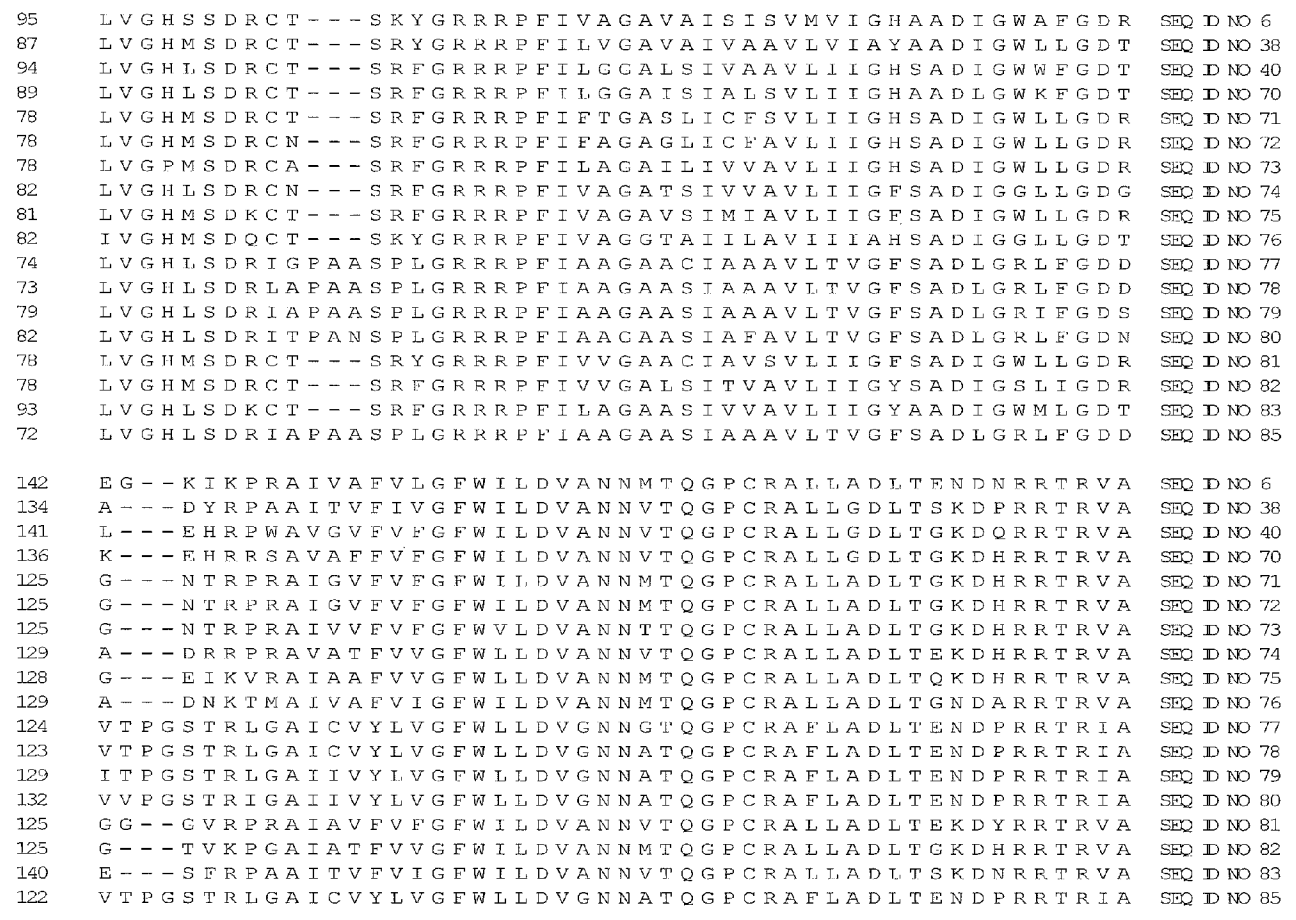
Figure 6C:
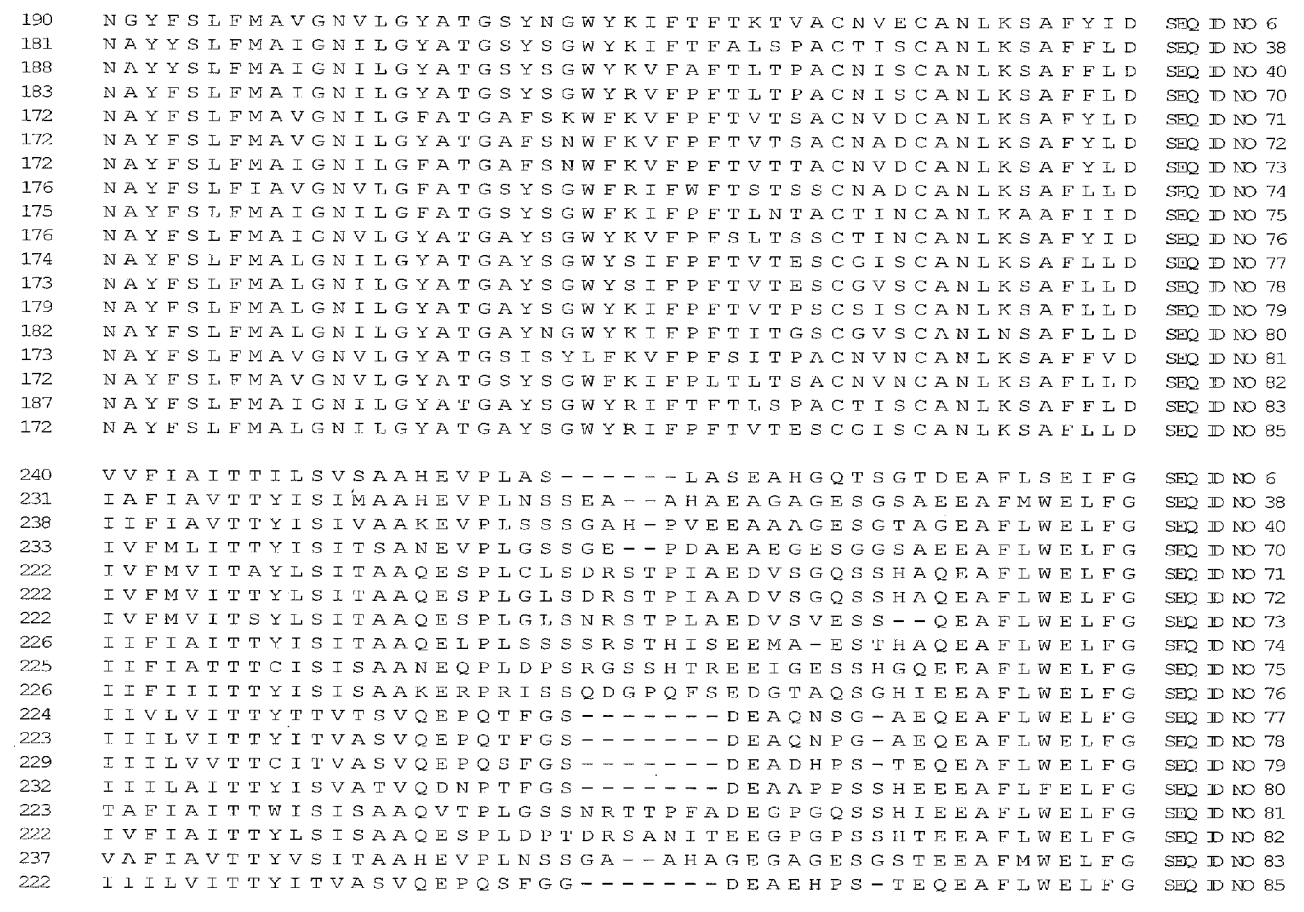
Figure 6D:
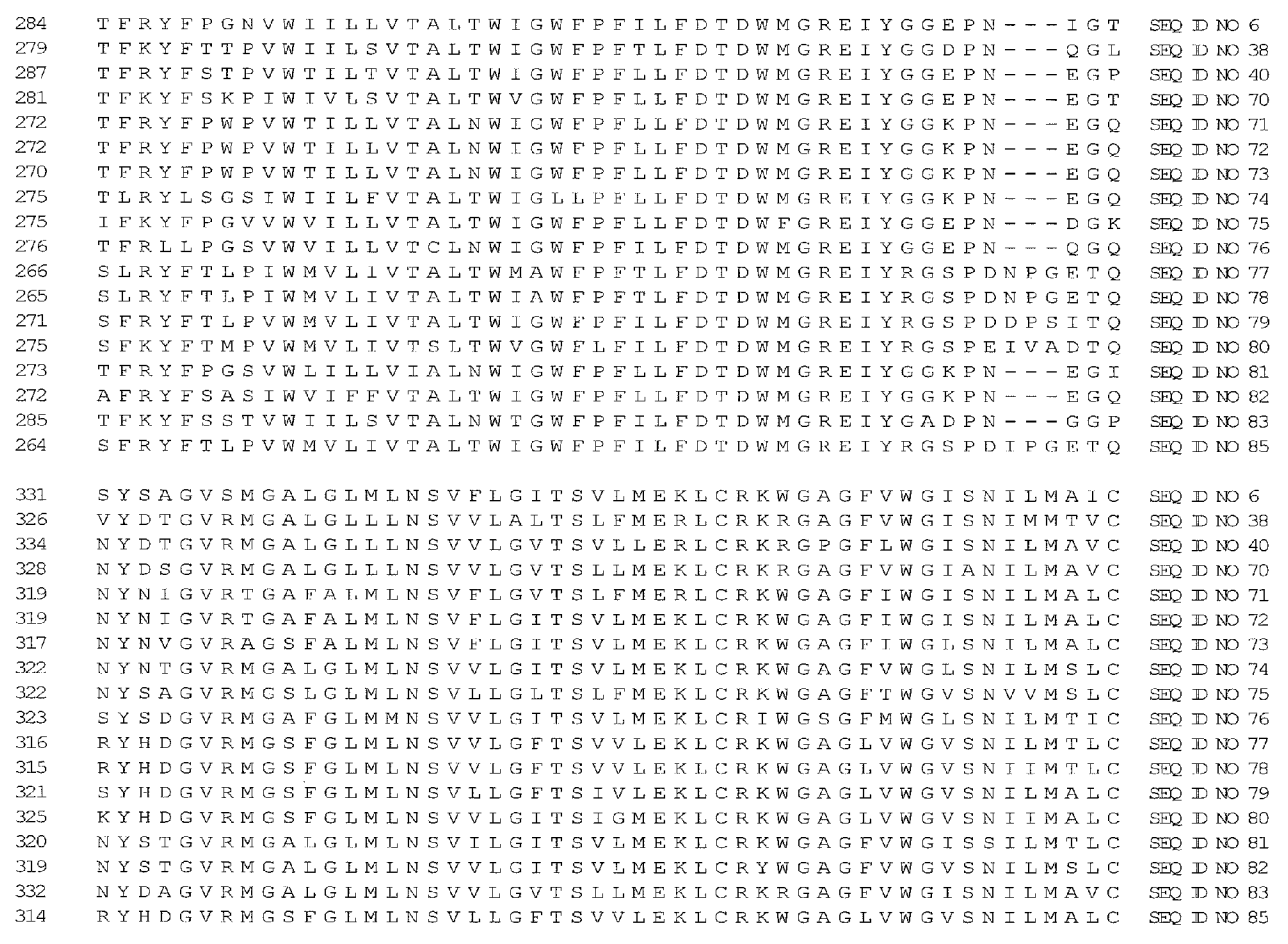

FIG. 6A-F presents an alignment of the amino acid sequences set forth in SEQ ID NOs: 6, 38, 40, 70-83, and 85 of the SUT4 subfamily.

FIG. 7 is a chart of the percent sequence identity and the divergence values for each pair of amino acids sequences presented in FIG. 4A-G.

FIG. 8 is a chart of the percent sequence identity and the divergence values for each pair of amino acids sequences presented in FIG. 5A-F.

FIG. 9 is a chart of the percent sequence identity and the divergence values for each pair of amino acids sequences presented in FIG. 6A-F.

Figure 10:
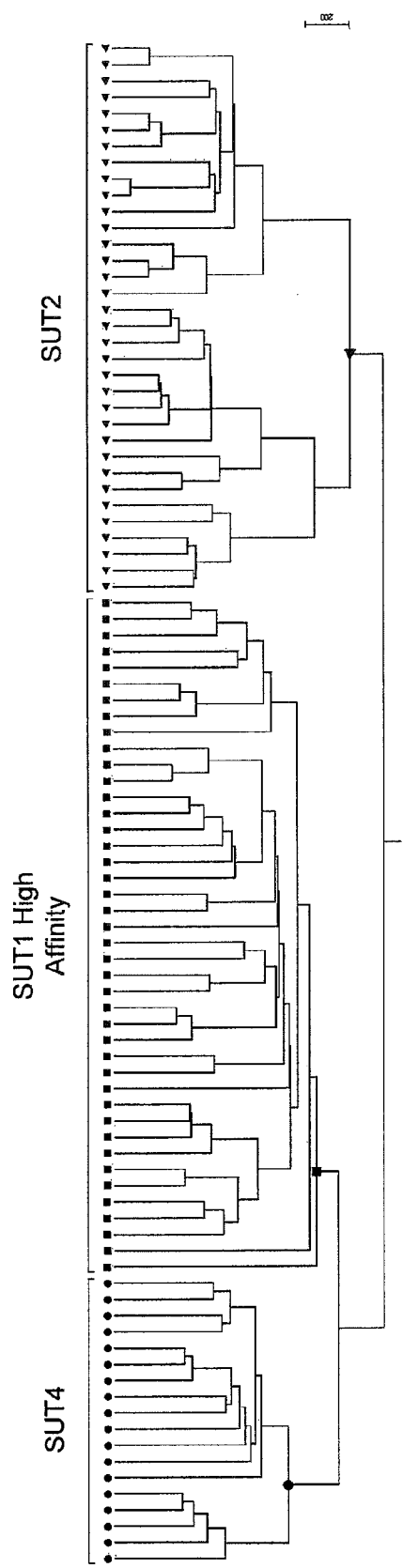

FIG. 10 presents phylogenetic analysis of the SUT1, SUT2, and SUT4 *Arabidopsis thaliana* genes and their homologs shown in Table 2 and Table 3. Black circles represent members of the SUT4 family black squares represent members of the SUT1 family, and black triangles represent members of the SUT2 family.

Figure 11A:
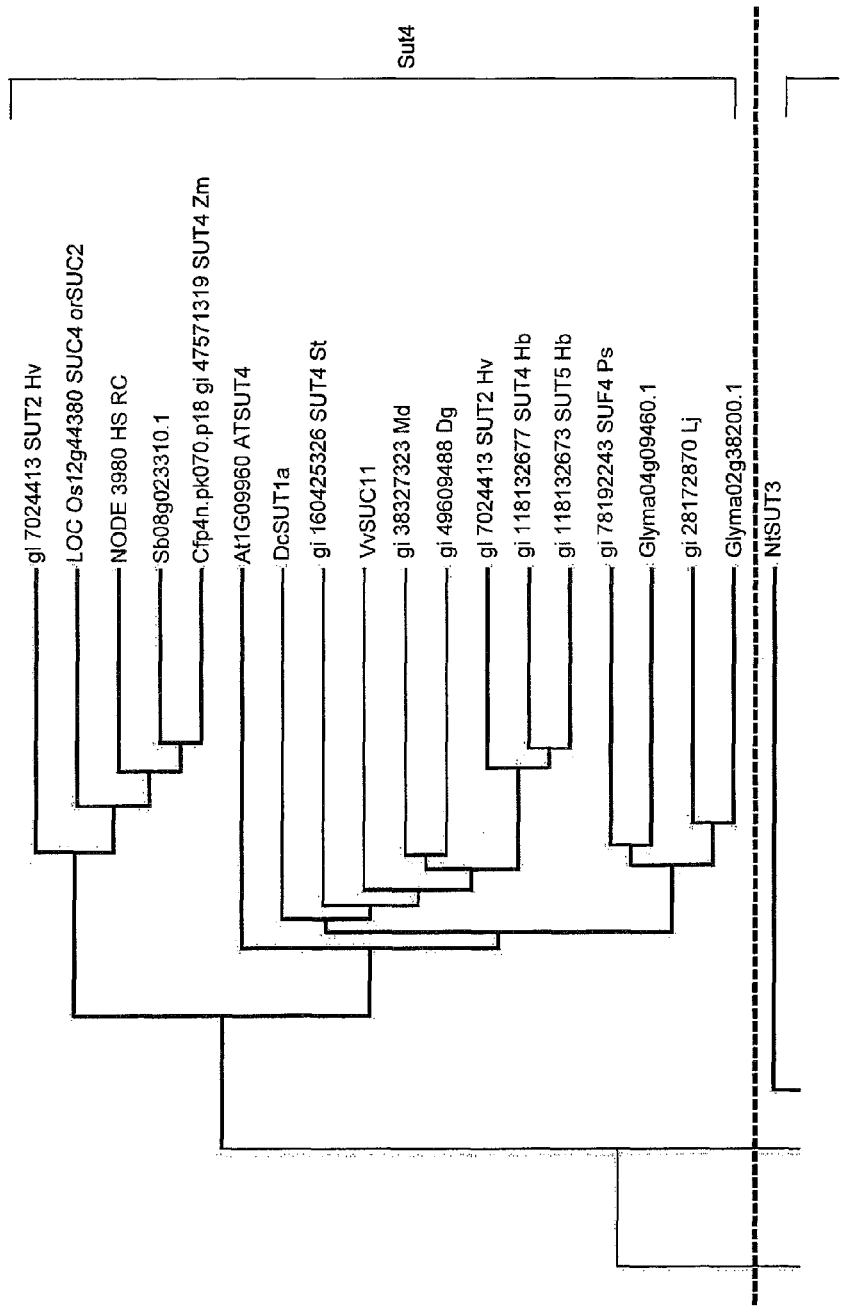
Figure 11B:
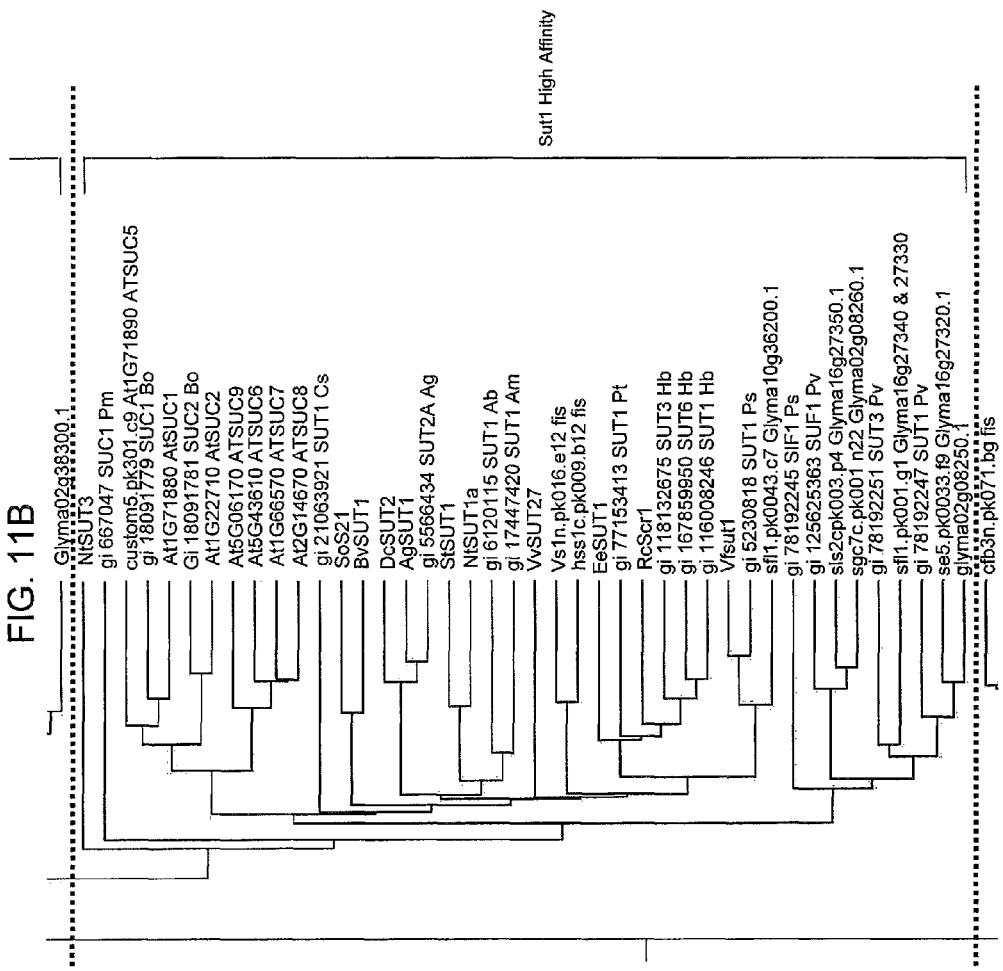
Figure 11C:
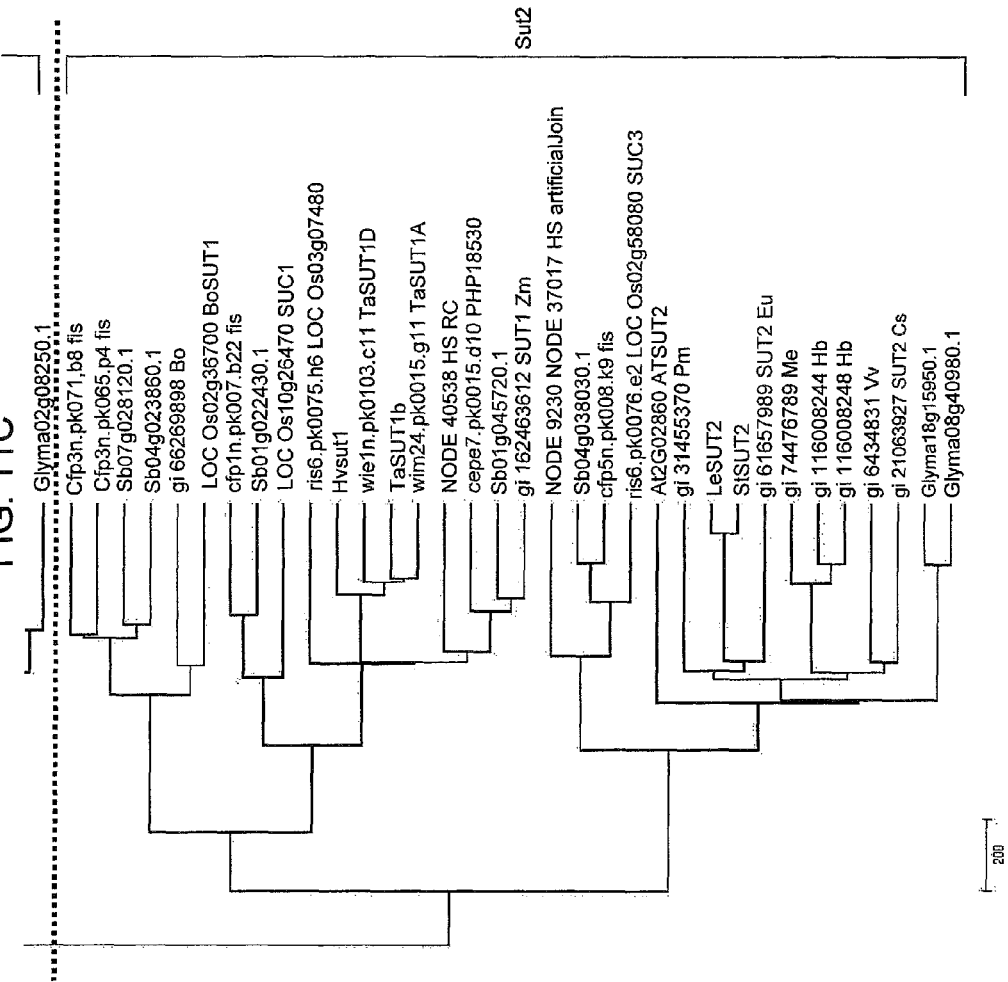

FIG. 11A-C presents an enlargement of the phylogenetic tree presented in FIG. 10. Dotted lines represent divisions between the SUT4 and SUT1 families and also between the SUT1 and SUT2 families.

FIG. 12 presents oil increase by sucrose transporters co-expressed with YLDGAT1.

The sequence descriptions (Table 1) and Sequence Listing attached hereto comply with the rules governing nucleotide and/or amino acid sequence disclosures in patent applications as set forth in 37 C.F.R. § 1.821-1.825. The Sequence Listing contains the one letter code for nucleotide sequence characters and the three letter codes for amino acids as defined in conformity with the IUPAC-IUBMB standards described in *Nucleic Acids Res.* 13:3021-3030 (1985) and in the *Biochemical J.* 219 (2):345-373 (1984) which are herein incorporated by reference. The symbols and format used for nucleotide and amino acid sequence data comply with the rules set forth in 37 C.F.R. § 1.822.

TABLE 1

| SEQ ID NO: | Identifier | Species | Sequence Type |
|---|---|---|---|
| 1 | AtSUC2 (At1G22710) | *Arabidopsis thaliana* | DNA |
| 2 | AtSUC2(At1G22710) | *Arabidopsis thaliana* | PRT |
| 3 | AtSUT2 (At2G02860) | *Arabidopsis thaliana* | DNA |
| 4 | AtSUT2(At2G02860) | *Arabidopsis thaliana* | PRT |
| 5 | AtSUT4 (At1G09960) | *Arabidopsis thaliana* | DNA |
| 6 | AtSUT4(At1G09960) | *Arabidopsis thaliana* | PRT |
| 7 | YOL737 (AtSUC2 primer) | Artificial sequence | DNA |
| 8 | YOL132 (AtSUC2 primer) | Artificial sequence | DNA |
| 9 | YOL174 (AtSUT2 primer) | Artificial sequence | DNA |
| 10 | YOL175 (AtSUT2 primer) | Artificial sequence | DNA |
| 11 | YOL172 AtSUT4 primer | Artificial sequence | DNA |
| 12 | YOL173 AtSUT4 primer | Artificial sequence | DNA |
| 13 | AtSUC2-pCRR2.1 | Artificial sequence | DNA |
| 14 | AtSUT2-pCR2.1 | Artificial sequence | DNA |
| 15 | AtSUT4-pCRR2.1 | Artificial sequence | DNA |
| 16 | AtSUC2HIS | Artificial sequence | DNA |
| 17 | AtSUT2HIS | Artificial sequence | DNA |
| 18 | AtSUT4HIS | Artificial sequence | DNA |
| 19 | YOL412 (AtSUC2 primer) | Artificial sequence | DNA |
| 20 | YOL413 (AtSUC2 primer) | Artificial sequence | DNA |
| 21 | YOL416 (ATSUT2 primer) | Artificial sequence | DNA |
| 22 | YOL417 (AtSUT2 primer) | Artificial sequence | DNA |
| 23 | YOL414 (AtSUT4 primer) | Artificial sequence | DNA |
| 24 | YOL415 (AtSUT4 primer) | Artificial sequence | DNA |
| 25 | RTW155 (AtSUC2HIS6) | Artificial sequence | DNA |
| 26 | RTW156 (AtSUT4HIS6) | Artificial sequence | DNA |
| 27 | RTW157 (AtSUT2HIS6) | Artificial sequence | DNA |
| 28 | RTW247 (yeast AtSUC2HIS) | Artificial sequence | DNA |
| 29 | RTW248 (yeast AtSUT4HIS) | Artificial sequence | DNA |
| 30 | RTW249 (yeast AtSUT2HIS) | Artificial sequence | DNA |
| 31 | RTW250 (yeast AtSUC2) | Artificial sequence | DNA |
| 32 | RTW251 (yeast AtSUT4) | Artificial sequence | DNA |
| 33 | Glyma08g40980 (SUT2) | *Glycine max* | DNA |
| 34 | Glyma08g40980 (SUT2) | *Glycine max* | PRT |
| 35 | Glyma18g15950 (SUT2) | *Glycine max* | DNA |
| 36 | Glyma18g15950 (SUT2) | *Glycine max* | PRT |
| 37 | Glyma02g38300 (SUT4) | *Glycine max* | DNA |
| 38 | Glyma02g38300 (SUT4) | *Glycine max* | PRT |
| 39 | Glyma04g09460 (SUT4) | *Glycine max* | DNA |
| 40 | Glyma04g09460 (SUT4) | *Glycine max* | PRT |
| 41 | CsSUT2 (NCBI GI NO. 21063927) | *Citrus sinensis* | PRT |
| 42 | EuSUT2 (NCBI GI NO. 61657989) | *Eucommia ulmoides* | PRT |
| 43 | StSUT2 (NCBI GI NO. 31096339) | *Solanum tuberosum* | PRT |
| 44 | LeSUT2 (NCBI GI NO. 10119908) | *Lycopersicon esculentum* | PRT |
| 45 | LOC_Os02g58080_SUC3 | *Oryza sativa* | PRT |
| 46 | cfp5n.pk008.k9_fis | *Zea mays* | PRT |
| 47 | Sb04g038030.1 | *Sorghum bicolor* | PRT |
| 48 | PmSUT2 (NCBI GI NO. 31455370) | *Plantago major* | PRT |
| 49 | MeSUT2 (NCBI GI NO. 74476789) | *Manihot esculenta* | PRT |
| 50 | HbSUT2 (NCBI GI NO. 116008244) | *Hevea brasiliensis* | PRT |
| 51 | Pn_Node_9230 | *Paspalum notatum* | DNA |
| 52 | Pn_Node_9230 | *Paspalum notatum* | PRT |
| 53 | ZmSUT1 (NCBI GI NO. 162463612) | *Zea mays* | PRT |

TABLE 1-continued

| SEQ ID NO: | Identifier | Species | Sequence Type |
|---|---|---|---|
| 54 | Sb01g045720.1 | *Sorghum bicolor* | PRT |
| 55 | cepe7.pk0015.d10 | *Zea mays* | PRT |
| 56 | TaSUT1A (NCBI GI NO. 20152871) | *Triticum aestivum* | PRT |
| 57 | TaSUT1b (NCBI GI NO. 20152873) | *Triticum aestivum* | PRT |
| 58 | TaSUT1D (NCBI GI NO. 19548165) | *Triticum aestivum* | PRT |
| 59 | HvSUT1 (NCBI GI NO. 71890897) | *Hordeum vulgare* | PRT |
| 60 | LOC_Os03g07480 | *Oryza sativa* | PRT |
| 61 | LOC_Os10g26470_SUC1 | *Oryza sativa* | PRT |
| 62 | Sb01g022430.1 | *Sorghum bicolor* | PRT |
| 63 | cfp1n.pk007.b22_fis | *Zea mays* | PRT |
| 64 | LOC_Os02g36700_BoSUT1 | *Oryza sativa* | PRT |
| 65 | Sb04g023860.1 | *Sorghum bicolor* | PRT |
| 66 | Sb07g028120.1 | *Sorghum bicolor* | PRT |
| 67 | BoSUT1_NCBI GI NO. 66269698 | *Bambusa oldhamii* | PRT |
| 68 | cfp1n.pk065.p4_fis | *Zea mays* | PRT |
| 69 | cfp3n.pk071.b8_fis | *Zea mays* | PRT |
| 70 | PsSUF4 (NCBI GI NO. 78192243) | *Pisum sativum* | PRT |
| 71 | HbSUT5 (NCBI GI NO. 118132673) | *Hevea brasiliensis* | PRT |
| 72 | HbSUT4 (NCBI GI NO. 118132677) | *Hevea brasiliensis* | PRT |
| 73 | MeSUT4 (NCBI GI NO. 74476785) | *Manihot esculenta* | PRT |
| 74 | VvSUC11 (NCBI GI NO. 6434829) | *Vitis vinifera* | PRT |
| 75 | StSUT4 (NCBI GI NO. 160425326) | *Solanum tuberosum* | PRT |
| 76 | DcSUT1a (NCBI GI NO. 2969887) | *Daucus carota* | PRT |
| 77 | ZmSUT4 (NCBI GI NO. 47571319) | *Zea mays* | PRT |
| 78 | Sb08g023310.1 | *Sorghum bicolor* | PRT |
| 79 | LOC_Os12g44380_SUC4_or SUC2 | *Oryza sativa* | PRT |
| 80 | HvSUT2 (NCBI GI NO. 7024413) | *Hordeum vulgare* | PRT |
| 81 | MdSUT4 (NCBI GI NO. 38327323) | *Malus x domestica* | PRT |
| 82 | DgSUT4 (NCBI GI NO. 49609488) | *Datisca glomerata* | PRT |
| 83 | LjSUT4 (NCBI GI NO. 28172870) | *Lotus japonicas* | PRT |
| 84 | Pn_Node_3980 | *Paspalum notatum* | DNA |
| 85 | Pn_Node_3980 | *Paspalum notatum* | PRT |
| 86 | ATSUC8 (At2G14670; NCBI GI NO. 15225986) | *Arabidopsis thaliana* | PRT |
| 87 | ATSUC7 (At1G66570; NCBI GI NO. 115646796) | *Arabidopsis thaliana* | PRT |
| 88 | AtSUC6 (At5G43610; NCBI GI NO. 15239921) | *Arabidopsis thaliana* | PRT |
| 89 | AtSUC9 (At5G06170; NCBI GI NO. 15239949) | *Arabidopsis thaliana* | PRT |
| 90 | AtSUC1 (At1G71880; NCBI GI NO. 56550707) | *Arabidopsis thaliana* | PRT |
| 91 | AtSUC5 (At1G71890; NCBI GI NO. 15217602) custom5.pk301.c9 | *Arabidopsis thaliana* | PRT |
| 92 | Glyma02g08250.1 | *Glycine max* | PRT |
| 93 | Glyma16g27320.1 | *Glycine max* | PRT |
| 94 | PvSUT1 (NCBI GI NO. 78192247) | *Phaseolus vulgaris* | PRT |
| 95 | sfl1.pk0001.g1_Glyma16g27340_&_27330 | *Glycine max* | PRT |
| 96 | PvSUT3 (NCBI GI NO. 78192251) | *Phaseolus vulgaris* | PRT |
| 97 | Glyma02g08260.1 | *Glycine max* | PRT |
| 98 | sls2c.pk003.p4_Glyma16g27350.1 | *Glycine max* | PRT |
| 99 | PvSUF1 (NCBI GI NO. 125625363) | *Phaseolus vulgaris* | PRT |
| 100 | SUF1_Ps (NCBI GI NO. 78192245) | *Pisum sativum* | PRT |
| 101 | Glyma10g36200.1 | *Glycine max* | PRT |
| 102 | PsSUT1 (NCBI GI NO. 5230818) | *Pisum sativum* | PRT |
| 103 | VfSut1 (NCBI GI NO. 1935019) | *Vicia faba* | PRT |
| 104 | HbSUT1 (NCBI GI NO. 116008246) | *Hevea brasiliensis* | PRT |
| 105 | HbSUT6 (NCBI GI NO. 167859950) | *Hevea brasiliensis* | PRT |
| 106 | HbSUT3 (NCBI GI NO. 118132675) | *Hevea brasiliensis* | PRT |
| 107 | RcScr1 (NCBI GI NO. 468562) | *Ricinus communis* | PRT |
| 108 | PtSUT1 (NCBI GI NO. 77153413) | *Populus tremula* x *Populus tremuloides* | PRT |
| 109 | EeSUT1 (NCBI GI NO. 7649151) | *Euphorbia esula* | PRT |
| 110 | hss1c.pk009.b12_fis | *Helianthus annuus* | PRT |
| 111 | vs1n.pk016.e12_fis | *Vernonia mespilifolia* | PRT |
| 112 | VvSUT27 (NCBI GI NO. 6434833) | *Vitis vinifera* | PRT |
| 113 | AmSUT1 (NCBI GI NO. 17447420) | *Alonsoa meridionalis* | PRT |
| 114 | AbSUT1 (NCBI GI NO. 6120115) | *Asarina barclaiana* | PRT |
| 115 | NtSUT1a (NCBI GI NO. 575351) | *Nicotiana tabacum* | PRT |
| 116 | StSUT1 (NCBI GI NO. 439294) | *Solanum tuberosum* | PRT |
| 117 | AgSUT2A (NCBI GI NO. 5566434) | *Apium graveolens* | PRT |
| 118 | AgSUT1 (NCBI GI NO. 4091891) | *Apium graveolens* | PRT |
| 119 | DcSUT2 (NCBI GI NO. 2969884) | *Daucus carota* | PRT |
| 120 | BvSUT1 (NCBI GI NO. 5823000) | *Beta vulgaris* | PRT |
| 121 | SoS21 (NCBI GI NO. 549000) | *Spinacia oleracea* | PRT |

TABLE 1-continued

| SEQ ID NO: | Identifier | Species | Sequence Type |
|---|---|---|---|
| 122 | CsSUT1 (NCBI GI NO. 21063921) | *Citrus sinensis* | PRT |
| 123 | BoSUC2 (NCBI GI NO. 18091781) | *Brassica oleracea* | PRT |
| 124 | BoSUC1 (NCBI GI NO. 18091779) | *Brassica oleracea* | PRT |
| 125 | PmSUC1 (NCBI GI NO. 667047) | *Plantago major* | PRT |
| 126 | NtSUT3 (NCBI GI NO. 4960089) | *Nicotiana tabacum* | PRT |
| 127 | YLDGAT1 | *Yarrowia lipolytica* | DNA |
| 128 | RTW218 | Artificial sequence | DNA |
| 129 | KS349 | Artificial sequence | DNA |
| 130 | pKR268 | Artificial sequence | DNA |
| 131 | RTW220 (AtSUC2HIS6 DGAT1 35Hyg) | Artificial sequence | DNA |
| 132 | RTW147 (ANN-myb2 term sbf) | Artificial sequence | DNA |
| 133 | RTW158p1 (ann suc2) | Artificial sequence | DNA |
| 134 | RTW221 (ATSUT4HIS6 DGAT1 35Hyg) | Artificial sequence | DNA |
| 135 | RTW162p1 (ann sut4) | Artificial sequence | DNA |
| 136 | RTW222 (ATSUT2HIS6 DGAT1 35Hyg) | Artificial sequence | DNA |
| 137 | RTW166p1 (ann SUT2) | Artificial sequence | DNA |
| 138 | RTW212(plasmid with soybean selection marker) | Artificial sequence | DNA |
| 139 | RTW226 | Artificial sequence | DNA |
| 140 | RTW227F (ATSUT4 DGAT1 ALS), soy expression clone | Artificial sequence | DNA |
| 141 | GmSut2-1For (Glyma08g40980 primer) | Artificial sequence | DNA |
| 142 | GmSut2-1Rev (Glyma08g40980 primer) | Artificial sequence | DNA |
| 143 | GmSut2-2For (Glyma18g15950 primer) | Artificial sequence | DNA |
| 144 | GmSut2-2Rev (Glyma18g15950 primer) | Artificial sequence | DNA |
| 145 | SA150 (Glyma02g38300 primer) | Artificial sequence | DNA |
| 146 | SA151(Glyma02g38300 primer) | Artificial sequence | DNA |
| 147 | SA148 (Glyma04g09460 primer) | Artificial sequence | DNA |
| 148 | SA149 (Glyma04g09460 primer) | Artificial sequence | DNA |
| 149 | Pn_Node_40538 | *Paspalum notatum* | DNA |
| 150 | Pn_Node_40538 | *Paspalum notatum* | PRT |
| 151 | Glyma02g38300 in pGEM-T Easy | Artificial sequence | DNA |
| 152 | pKR1680 | Artificial sequence | DNA |
| 153 | pKR1684 | Artificial sequence | DNA |
| 154 | pLF235 | Artificial sequence | DNA |
| 155 | pKR1681 | Artificial sequence | DNA |
| 156 | pKR1685 | Artificial sequence | DNA |
| 157 | GmSut4-2For | Artificial sequence | DNA |
| 158 | GmSut4-2Rev | Artificial sequence | DNA |
| 159 | pLF236 | Artificial sequence | DNA |
| 160 | pKR1682 | Artificial sequence | DNA |
| 161 | pKR1686 | Artificial sequence | DNA |
| 162 | pKR1468 | Artificial sequence | DNA |
| 163 | pKR1691 | Artificial sequence | DNA |
| 164 | pKR1698 | Artificial sequence | DNA |
| 165 | pKR1699 | Artificial sequence | DNA |
| 166 | pKR1700 | Artificial sequence | DNA |
| 167 | pKR1701 | Artificial sequence | DNA |
| 168 | pKR1363 | Artificial sequence | DNA |
| 169 | pKR1331 | Artificial sequence | DNA |
| 170 | pKR1365 | Artificial sequence | DNA |
| 171 | pKR1374 | Artificial sequence | DNA |
| 172 | pKR1598 | Artificial sequence | DNA |
| 173 | pKR1600 | Artificial sequence | DNA |
| 174 | pKR1602 | Artificial sequence | DNA |
| 175 | pKR1658 | Artificial sequence | DNA |
| 176 | pKR1661 | Artificial sequence | DNA |
| 177 | hso1c.pk009.l6:fis | *Helianthus annuus* | DNA |
| 178 | hso1c.pk009.l6:fis:+2 Frame +2 translation | *Helianthus annuus* | PRT |
| 179 | YLDGAT2 | *Yarrowia lipolytica* | DNA |
| 180 | YLDGAT2 | *Yarrowia lipolytica* | PRT |
| 181 | YLDGAT1 gene codon optimized for soybean | Artifical Sequence | DNA |
| 182 | YLDGAT1 gene codon optimized for soybean | Artifical Sequence | PRT |
| 183 | YLDGAT2 gene codon optimized for soybean | Artifical Sequence | DNA |

TABLE 1-continued

| SEQ ID NO: | Identifier | Species | Sequence Type |
|---|---|---|---|
| 184 | YLDGAT2 gene codon optimized for soybean | Artifical Sequence | PRT |
| 185 | YLDGAT2 comprising codon 326 mutated from Tyr to Phe | Artifical Sequence | DNA |
| 186 | YLDGAT2 comprising codon 326 mutated from Tyr to Phe | Artifical Sequence | PRT |
| 187 | YLDGAT2 comprising codon 326 mutated from Tyr to Leu | Artifical Sequence | DNA |
| 188 | YLDGAT2 comprising codon 326 mutated from Tyr to Leu | Artifical Sequence | PRT |
| 189 | YLDGAT2 comprising codon 327 mutated from Arg to Lys | Artifical Sequence | DNA |
| 190 | YLDGAT2 comprising codon 327 mutated from Arg to Lys | Artifical Sequence | PRT |
| 191 | YLDGAT1 | *Yarrowia lipolytica* | PRT |

DETAILED DESCRIPTION OF THE INVENTION

The disclosure of each reference set forth herein is hereby incorporated by reference in its entirety.

As used herein and in the appended claims, the singular forms "a", "an", and "the" include plural reference unless the context clearly dictates otherwise. Thus, for example, reference to "a plant" includes a plurality of such plants, reference to "a cell" includes one or more cells and equivalents thereof known to those skilled in the art, and so forth.

As used herein:

The terms "monocot" and "monocotyledonous plant" are used interchangeably herein. A monocot of the current invention includes the Gramineae.

The terms "dicot" and "dicotyledonous plant" are used interchangeably herein. A dicot of the current invention includes the following Brassicaceae, Leguminosae, and Solanaceae.

The terms "full complement" and "full-length complement" are used interchangeably herein, and refer to a complement of a given nucleotide sequence, wherein the complement and the nucleotide sequence consist of the same number of nucleotides and are 100% complementary.

"Transgenic" refers to any cell, cell line, callus, tissue, plant part or plant, the genome of which has been altered by the presence of a heterologous nucleic acid, such as a recombinant DNA construct, including those initial transgenic events as well as those created by sexual crosses or asexual propagation from the initial transgenic event. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

"Genome" as it applies to plant cells encompasses not only chromosomal DNA found within the nucleus, but organelle DNA found within subcellular components (e.g., mitochondrial, plastid) of the cell.

"Plant" includes reference to whole plants, plant organs, plant tissues, seeds and plant cells and progeny of same. Plant cells include, without limitation, cells from seeds, suspension cultures, embryos, meristematic regions, callus tissue, leaves, roots, shoots, gametophytes, sporophytes, pollen, and microspores.

As used herein, the term plant also includes plant protoplasts, plant cell tissue cultures from which plants can be regenerated, plant clumps, and plant cells that are intact in plants or parts of plants such as embryos, pollen, ovules, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

In one embodiment, any plant species may be utilized in the invention, including, but not limited to, monocots and dicots. Examples of plants that may be used in the invention include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Titicum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables of interest include, but are not limited to, tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*) and chrysanthemum.

Conifers of interest that may be employed in practicing the present invention include, but are not limited to, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Hardwood trees can also be employed including ash, aspen, beech, basswood, birch, black cherry, black walnut, buckeye, American chestnut, cottonwood, dogwood, elm, hackberry, hickory, holly, locust, magnolia, maple, oak, poplar, red alder, redbud, royal paulownia, sassafras, sweetgum, sycamore, tupelo, willow, yellow-poplar.

In specific embodiments, plants of the present invention are crop plants (for example, corn, alfalfa, sunflower, *Brassica*, soybean, cotton, safflower, peanut, sorghum, wheat, millet, tobacco, etc.). In other embodiments, corn and soybean and sugarcane plants are optimal, and in yet other embodiments corn plants are optimal.

Other plants of interest include grain plants that provide seeds of interest, oil-seed plants, and leguminous plants. Seeds of interest include grain seeds, such as corn, wheat, barley, rice, sorghum, rye, etc. Oil-seed plants include cotton, soybean, safflower, sunflower, *Brassica*, maize, alfalfa, palm, coconut, etc. Leguminous plants include beans and peas. Beans include guar, locust bean, fenugreek, soybean, garden beans, cowpea, mungbean, lima bean, fava bean, lentils, chickpea, etc.

Other plants of interest including Turfgrasses such as, for example, turfgrasses from the genus *Poa, Agrostis, Festuca, Latium*, and *Zoysia*. Additional turfgrasses can come from the subfamily Panicoideae. Turfgrasses can further include, but are not limited to, Blue gramma (*Bouteloua gracilis* (H.B.K.) Lag. Ex Griffiths); Buffalograss (*Buchloe dactyloids* (Nutt.) Engelm.); Slender creeping red fescue (*Festuca rubra* ssp. *Litoralis*); Red fescue (*Festuca rubra*); Colonial bentgrass (*Agrostis tenuis* Sibth.); Creeping bentgrass (*Agrostis palustris* Huds.); Fairway wheatgrass (*Agropyron cristatum* (L.) Gaertn.); Hard fescue (*Festuca longifolia* Thuill.); Kentucky bluegrass (*Poa pratensis* L.); Perennial ryegrass (*Lolium perenne* L.); Rough bluegrass (*Poa trivialis* L.); Sideoats grama (*Bouteloua curtipendula* Michx. Torr.); Smooth bromegrass (*Bromus inermis* Leyss.); Tall fescue (*Festuca arundinacea* Schreb.); Annual bluegrass (*Poa annua* L.); Annual ryegrass (*Lolium multiflorum* Lam.); Redtop (*Agrostis alba* L.); Japanese lawn grass (*Zoysia japonica*); bermudagrass (*Cynodon daetylon; Cynodon* spp. LC. Rich; *Cynodon transvaalensis*); Seashore paspalum (*Paspalum vaginatum* Swartz); Zoysiagrass (*Zoysia* spp. Willd; *Zoysia japonica* and *Z. matrella* var. *matrella*); Bahiagrass (*Paspalum notatum* Flugge); Carpetgrass (*Axonopus affinis* Chase); Centipedegrass (*Eremochloa ophiuroides* Munro Hack.); Kikuyugrass (*Pennisetum clandesinum* Hochst Ex Chiov); Browntop bent (*Agrostis tenuis* also known as *A. capillaris*); Velvet bent (*Agrostis canina*); Perennial ryegrass (*Lolium perenne*); and, St. Augustinegrass (*Stenotaphrum secundatum* Walt. Kuntze). Additional grasses of interest include switchgrass (*Panicum virgatum*).

"Progeny" comprises any subsequent generation of a plant.

"Regeneration" or "regenerated" plants is intended to mean that transformed plant cells may be grown into plants in accordance with conventional ways. See, for example, McCormick et al. (1986) *Plant Cell Reports* 5:81-84. These plants may then be grown, and either pollinated with the same transformed strain or different strains, and the resulting progeny having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a polynucleotide of the invention, for example, an expression cassette of the invention, stably incorporated into their genome.

"Transgenic plant" includes reference to a plant which comprises within its genome heterologous polynucleotide. For example, the heterologous polynucleotide is stably integrated within the genome such that the polynucleotide is passed on to successive generations. The heterologous polynucleotide may be integrated into the genome alone or as part of a recombinant DNA construct.

"Heterologous" with respect to sequence means a sequence that originates from a foreign species, or, if from the same species, is substantially modified from its native form in composition and/or genomic locus by deliberate human intervention.

"Polynucleotide", "nucleic acid sequence", "nucleotide sequence", or "nucleic acid fragment" are used interchangeably to refer to a polymer of RNA or DNA that is single- or double-stranded, optionally containing synthetic, non-natural or altered nucleotide bases. Nucleotides (usually found in their 5'-monophosphate form) are referred to by their single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

"Polypeptide", "peptide", "amino acid sequence" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The terms "polypeptide", "peptide", "amino acid sequence", and "protein" are also inclusive of modifications including, but not limited to, glycosylation, lipid attachment, sulfation, gamma-carboxylation of glutamic acid residues, hydroxylation and ADP-ribosylation.

"Messenger RNA (mRNA)" refers to the RNA that is without introns and that can be translated into protein by the cell.

"cDNA" refers to a DNA that is complementary to and synthesized from an mRNA template using the enzyme reverse transcriptase. The cDNA can be single-stranded or converted into the double-stranded form using the Klenow fragment of DNA polymerase I.

"Coding region" refers to a polynucleotide sequence that when transcribed, processed, and/or translated results in the production of a polypeptide sequence.

An "Expressed Sequence Tag" ("EST") is a DNA sequence derived from a cDNA library and therefore is a sequence which has been transcribed. An EST is typically obtained by a single sequencing pass of a cDNA insert. The sequence of an entire cDNA insert is termed the "Full-Insert Sequence" ("FIS"). A "Contig" sequence is a sequence assembled from two or more sequences that can be selected from, but not limited to, the group consisting of an EST, FIS and PCR sequence. A sequence encoding an entire or functional protein is termed a "Complete Gene Sequence" ("CGS") and can be derived from an FIS or a contig.

"Mature" protein refers to a post-translationally processed polypeptide; i.e., one from which any pre- or pro-peptides present in the primary translation product have been removed.

"Precursor" protein refers to the primary product of translation of mRNA; i.e., with pre- and pro-peptides still present. Pre- and pro-peptides may be and are not limited to intracellular localization signals.

"Isolated" refers to materials, such as nucleic acid molecules and/or proteins, which are substantially free or otherwise removed from components that normally accompany or interact with the materials in a naturally occurring environment. Isolated polynucleotides may be purified from a host cell in which they naturally occur. Conventional nucleic acid purification methods known to skilled artisans may be used to obtain isolated polynucleotides. The term also embraces recombinant polynucleotides and chemically synthesized polynucleotides.

"Recombinant" refers to an artificial combination of two otherwise separated segments of sequence, e.g., by chemical synthesis or by the manipulation of isolated segments of nucleic acids by genetic engineering techniques. "Recombinant" also includes reference to a cell or vector, that has been modified by the introduction of a heterologous nucleic acid or a cell derived from a cell so modified, but does not encompass the alteration of the cell or vector by naturally occurring events (e.g., spontaneous mutation, natural transformation/transduction/transposition) such as those occurring without deliberate human intervention.

"Recombinant DNA construct" refers to a combination of nucleic acid fragments that are not normally found together in nature. Accordingly, a recombinant DNA construct may comprise regulatory sequences and coding sequences that are derived from different sources, or regulatory sequences and coding sequences derived from the same source, but arranged in a manner different than that normally found in nature.

The terms "entry clone" and "entry vector" are used interchangeably herein.

"Regulatory sequences" or "regulatory elements" are used interchangeably and refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to, promoters, translation leader sequences, introns, and polyadenylation recognition sequences. The terms "regulatory sequence" and "regulatory element" are used interchangeably herein.

"Promoter" refers to a nucleic acid fragment capable of controlling transcription of another nucleic acid fragment.

"Promoter functional in a plant" is a promoter capable of controlling transcription in plant cells whether or not its origin is from a plant cell.

"Tissue-specific promoter" and "tissue-preferred promoter" are used interchangeably to refer to a promoter that is expressed predominantly but not necessarily exclusively in one tissue or organ, but that may also be expressed in one specific cell.

"Developmentally regulated promoter" refers to a promoter whose activity is determined by developmental events.

"Operably linked" refers to the association of nucleic acid fragments in a single fragment so that the function of one is regulated by the other. For example, a promoter is operably linked with a nucleic acid fragment when it is capable of regulating the transcription of that nucleic acid fragment.

"Expression" refers to the production of a functional product. For example, expression of a nucleic acid fragment may refer to transcription of the nucleic acid fragment (e.g., transcription resulting in mRNA or functional RNA) and/or translation of mRNA into a precursor or mature protein.

"Overexpression" refers to the production of a gene product in transgenic organisms that exceeds levels of production in a null segregating (or non-transgenic) organism from the same experiment.

"Phenotype" means the detectable characteristics of a cell or organism.

"Introduced" in the context of inserting a nucleic acid sequence or fragment (e.g., a recombinant DNA construct) into a cell, means "transfection" or "transformation" or "transduction" and includes reference to the incorporation of a nucleic acid fragment into a eukaryotic or prokaryotic cell where the nucleic acid sequence or fragment may be incorporate into the genome of the cell (e.g., chromosome, plasmid, plastid or mitochondrial DNA), converted into an autonomous replicon, or transiently expressed (e.g., transfected mRNA).

A "transformed cell" is any cell into which a nucleic acid sequence or fragment (e.g., a recombinant DNA construct) has been introduced.

"Transformation" as used herein refers to both stable transformation and transient transformation.

"Stable transformation" refers to the introduction of a nucleic acid fragment into a genome of a host organism resulting in genetically stable inheritance. Once stably transformed, the nucleic acid fragment is stably integrated in the genome of the host organism and any subsequent generation.

"Transient transformation" refers to the introduction of a nucleic acid fragment into the nucleus, or DNA-containing organelle, of a host organism resulting in gene expression without genetically stable inheritance.

The term "crossed" or "cross" means the fusion of gametes via pollination to produce progeny (e.g., cells, seeds or plants). The term encompasses both sexual crosses (the pollination of one plant by another) and selling (self-pollination, e.g., when the pollen and ovule are from the same plant). The term "crossing" refers to the act of fusing gametes via pollination to produce progeny.

A "favorable allele" is the allele at a particular locus that confers, or contributes to, a desirable phenotype, e.g., increased cell wall digestibility, or alternatively, is an allele that allows the identification of plants with decreased cell wall digestibility that can be removed from a breeding program or planting ("counterselection"). A favorable allele of a marker is a marker allele that segregates with the favorable phenotype, or alternatively, segregates with the unfavorable plant phenotype, therefore providing the benefit of identifying plants.

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid sequence or fragment (e.g., a recombinant DNA construct/expression construct) into a cell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid or mitochondrial DNA), converted into an autonomous replicon, or transiently expressed (e.g., transfected mRNA).

"Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of MRNA or protein/enzyme expressed by the target gene, and/or the level of the enzyme activity or protein functionality. The terms "suppression", "suppressing" and "silencing", used interchangeably herein, include lowering, reducing, declining, decreasing, inhibiting, eliminating or preventing. "Silencing" or "gene silencing" does not specify mechanism and is inclusive, and not limited to, anti-sense, cosuppression, viral-suppression, hairpin suppression, stem-loop suppression, RNAi-based approaches, and small RNA-based approaches.

A suppression construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identical) to all or part of the sense strand (or antisense strand) of the gene of interest.

Suppression DNA constructs are well-known in the art, are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target gene or gene product. "Antisense RNA" refers to an RNA transcript that is complementary to all or part of a target primary transcript or mRNA and that blocks the expression of a target isolated nucleic acid fragment (U.S. Pat. No. 5,107,065). The complementarity of an antisense RNA may be with any part of the specific gene transcript, i.e., at the 5' non-coding sequence, 3' non-coding sequence, introns, or the coding sequence.

"Cosuppression" refers to the production of sense RNA transcripts capable of suppressing the expression of the target gene or gene product. "Sense" RNA refers to RNA transcript that includes the mRNA and can be translated into protein within a cell or in vitro. Cosuppression constructs in plants have been previously designed by focusing on over-expression of a nucleic acid sequence having homology to a native mRNA, in the sense orientation, which results in the reduction of all RNA having homology to the overexpressed sequence (see Vaucheret et al., Plant J. 16:651-659 (1998); and Gura, Nature 404:804-808 (2000)).

Another variation describes the use of plant viral sequences to direct the suppression of proximal MRNA encoding sequences (per Publication No. WO 98/36083 published on Aug. 20, 1998).

RNA interference refers to the process of sequence-specific post-transcriptional gene silencing animals mediated by short interfering RNAs (siRNAs) (Fire et al. Nature 391:806 (1998)). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., Trends Genet. 15:358 (1999)).

Small RNAs play an important role in controlling gene expression. Regulation of many developmental processes, including flowering, is controlled by small RNAs. It is now possible to engineer changes in gene expression of plant genes by using transgenic constructs which produce small RNAs in the plant.

Small RNAs appear to function by base-pairing to complementary RNA or DNA target sequences. When bound to RNA, small RNAs trigger either RNA cleavage or translational inhibition of the target sequence. When bound to DNA target sequences, it is thought that small RNAs can mediate DNA methylation of the target sequence. The consequence of these events, regardless of the specific mechanism, is that gene expression is inhibited.

MicroRNAs (miRNAs) are noncoding RNAs of about 19 to about 24 nucleotides (nt) in length that have been identified in both animals and plants (Lagos-Quintana et al., Science 294:853-858 (2001), Lagos-Quintana et al., Curr. Biol. 12:735-739 (2002); et al., Science 294:858-862 (2001); Lee and Ambros, Science 294:862-864 (2001); Llave et al., Plant Cell 14:1605-1619 (2002); Mourelatos et al., Genes. Dev. 16:720-728 (2002); Park et al., Curr. Biol. 12:1484-1495 (2002); Reinhart et al., Genes. Dev. 16:1616-1626 (2002)). They are processed from longer precursor transcripts that range in size from approximately 70 to 200 nt, and these precursor transcripts have the ability to form stable hairpin structures.

MicroRNAs (miRNAs) appear to regulate target genes by binding to complementary sequences located in the transcripts produced by these genes. It seems likely that miRNAs can enter at least two pathways of target gene regulation: (1) translational inhibition; and (2) RNA cleavage. MicroRNAs entering the RNA cleavage pathway are analogous to the 21-25 nt short interfering RNAs (siRNAs) generated during RNA interference (RNAi) in animals and posttranscriptional gene silencing (PTGS) in plants, and likely are incorporated into an RNA-induced silencing complex (RISC) that is similar or identical to that seen for RNAi.

Sequence alignments and percent identity calculations may be determined using a variety of comparison methods designed to detect homologous sequences including, but not limited to, the MEGALIGN® program of the LASER-GENE® bioinformatics computing suite (DNASTAR® Inc., Madison, Wis.). Multiple alignment of the sequences provided herein were performed using the Clustal W method of alignment (Thompson, J. D., et al. (1994) Nucleic Acids

*Research* 22: 4673-80) with the default parameters (GAP PENALTY=10, GAP LENGTH PENALTY=0.2, DELAY DEVERGENT SEQS (%)=30%, DNA TRANSITION WEIGHT=0.5, PROTEIN WEIGHT MATRIX "Gonnet Series"). Default parameters for pairwise alignments using the Clustal W method were SLOW-ACCURATE, GAP PENALTY=10, GAP LENGTH=0.10, PROTEIN WEIGHT MATRIX "Gonnet 250".

After alignment of the sequences, using the Clustal W program, it is possible to obtain "percent identity" and "divergence" values by viewing the "sequence distances" table on the same program; unless stated otherwise, percent identities and divergences provided in the figures were calculated in this manner. In specific embodiments, the various sequences employed in the various methods and compositions disclosed herein can be aligned to the recited SEQ ID NOs based on the Clustal W method of alignment with pairwise alignment default parameters. For amino acid sequences the following parameters are used: KTUPLE=1, GAP PENALTY=3, WINDOW=5 and DIAGONALS SAVED=5. For nucleic acid sequences the following parameters are used: KTUPLE=2, GAP PENALTY=5, WINDOW=4 and DIAGONALS SAVED=4.

It is recognized that sequence alignments and percent identity calculations may be determined using other mathematical algorithms which would be known to those of ordinary skill in the art. Non-limiting examples of such mathematical algorithms are the algorithm of Myers and Miller (1988) *CABIOS* 4:11-17; the local alignment algorithm of Smith et al (1981) *Adv. Appl. Math.* 2:482; the global alignment algorithm of Needleman and Wunsch (1970) *J. Mol. Biol.* 48:443-453; the search-for-local alignment method of Pearson and Lipman (1988) *Proc. Natl. Acad. Sci.* 85:2444-2448; the algorithm of Karlin and Altschul (1990) *Proc. Natl. Acad. Sci. USA* 872264, modified as in Karlin and Altschul (1993) *Proc. Natl. Acad. Sci. USA* 90:5873-5877.

Computer implementations of these mathematical algorithms can be utilized for comparison of sequences to determine sequence identity. Such implementations include, but are not limited to: the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The ALIGN program is based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et al (1990) *J. Mol. Biol.* 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, PSI-BLAST, the default parameters of the respective programs (e.g., BLASTN for nucleotide sequences, BLASTX for proteins) can be used. See www.ncbi.nlm.nih.gov. Alignment may also be performed manually by inspection.

Unless otherwise stated, sequence identity/similarity values provided herein refer to the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by GAP Version 10.

GAP uses the algorithm of Needleman and Wunsch (1970) *J. Mol. Biol.* 48:443-453, to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the GCG Wisconsin Genetics Software Package for protein sequences are 8 and 2, respectively. For nucleotide sequences the default gap creation penalty is 50 while the default gap extension penalty is 3. The gap creation and gap extension penalties can be expressed as an integer selected from the group of integers consisting of from 0 to 200. Thus, for example, the gap creation and gap extension penalties can be 0, 1, 2, 3, 4, 5, 6, 7, 8, 9, 10, 15, 20, 25, 30, 35, 40, 45, 50, 55, 60, 65 or greater.

GAP presents one member of the family of best alignments. There may be many members of this family, but no other member has a better quality. GAP displays four figures of merit for alignments: Quality, Ratio, Identity, and Similarity. The Quality is the metric maximized in order to align the sequences. Ratio is the quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold. The scoring matrix used in Version 10 of the GCG Wisconsin Genetics Software Package is BLOSUM62 (see Henikoff and Henikoff (1989) *Proc. Natl. Acad. Sci. USA* 89:10915).

As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two polynucleotides. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

Standard recombinant DNA and molecular cloning techniques used herein are well known in the art and are described more fully in Sambrook, J., Fritsch, E. F. and Maniatis, T. *Molecular Cloning: A Laboratory Manual*; Cold Spring Harbor Laboratory Press: Cold Spring Harbor, 1989 (hereinafter "Sambrook").

The compositions and methods disclosed herein employ a variety of sequences that encode sucrose transporters and a variety of sequences that influence fatty acid accumulation, including for example, DGAT, Lec1 and ODP1 transcription factor. Variant polynucleotides and polypeptides of these sequences are provided. Variants of such polynucleotides (i.e., sequences that encode the sucrose transporters or the sequences that influence fatty acid accumulation (i.e., the SUT2, SUT4, DGAT, lec1 and ODP1 sequences), and polypeptides encoded thereby, can be employed in the methods and compositions disclosed herein. As used herein, "variants" is intended to mean substantially similar sequences. For polynucleotides, a variant comprises a polynucleotide having deletions (i.e., truncations) at the 5' and/or 3' end; deletion and/or addition of one or more nucleotides at one or more internal sites in the native polynucleotide; and/or substitution of one or more nucleotides at one or more sites in the native polynucleotide. As used herein, a "native" polynucleotide or polypeptide comprises a naturally occurring nucleotide sequence or amino acid sequence, respectively. For polynucleotides, conservative variants include those sequences that, because of the degeneracy of the genetic code, encode the amino acid sequence of one of the sucrose transporters or the sequences that influence fatty acid accumulation (i.e., the SUT2, SUT4, DGAT, lec1 and ODP1 sequences). Naturally occurring allelic variants such as these can be identified with the use of well-known molecular biology techniques, as, for example, with polymerase chain reaction (PCR) and hybridization techniques as outlined below. Variant polynucleotides also include synthetically derived polynucleotides, such as those generated, for example, by using site-directed mutagenesis but which still encode one of the sucrose transporters or the sequences that influence fatty acid accumulation (i.e., the SUT2, SUT4, DGAT, lec1 and ODP1 sequences). Generally, variants of a particular polynucleotide of the invention (i.e., a SUT2, SUT4 and/or a DGAT, Lec1 or ODP-1) will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide (i.e., to any one of SEQ ID NOS: 1, 3, 5, 33, 35, 37, 39, 127, 177, 179, 181, 183, 185, 187, or 189 as determined by sequence alignment programs and parameters as described elsewhere herein.

Variants of a particular polynucleotide of the invention (i.e., the reference polynucleotide) can also be evaluated by comparison of the percent sequence identity between the polypeptide encoded by a variant polynucleotide and the polypeptide encoded by the reference polynucleotide. Thus, for example, an isolated polynucleotide that encodes a polypeptide with a given percent sequence identity to the polypeptide of SEQ ID NO: 4, 6, 34, 36, 38, 40-50, 52-83, 178, 180, 182, 184, 186, 188, 190, or 191 is disclosed. Percent sequence identity between any two polypeptides can be calculated using sequence alignment programs and parameters described elsewhere herein. Where any given pair of polynucleotides of the invention is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity.

As used herein, a "variant" polypeptide is intended to mean a polypeptide derived from the native polypeptide or by deletion (so-called truncation) of one or more amino acids at the N-terminal and/or C-terminal end of the native polypeptide; deletion and/or addition of one or more amino acids at one or more internal sites in the native polypeptide; or substitution of one or more amino acids at one or more sites in the native polypeptide, Variant polypeptides encompassed by the present invention are biologically active, that is they continue to possess the desired biological activity of the native polypeptide, that is, sucrose transport activity as described herein, influence oil accumulation, or have DGAT, ODP-1 or Lec1 activity. Such variants may result from, tier example, genetic polymorphism or from human manipulation. Biologically active variants of the sucrose transporters (i.e., SUT2 or SUT4) or of the sequences that influence fatty acid accumulation (i.e., DGAT, lec1 and ODP1 sequences) employed in the various methods and compositions disclosed herein will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence for the polypeptide (i.e., to any one of the amino acid sequences set forth in 4, 6, 34, 38, 40-50, 52-83, 178, 180, 182, 184, 186, 188, 190 or 191 as determined by sequence alignment programs and parameters described elsewhere herein. A biologically active variant of a polypeptide of the invention may differ from that polypeptide by as few as 115 amino acid residues, as few as such as 6-10, as few as 5, as few as 4, 3, 2, or even 1 amino acid residue.

The polypeptides employed herein (i.e., the sucrose transporters or the sequences that influence fatty acid accumulation (i.e., the SUT2, SUT4, DGAT, lec1 and ODP1 sequences)) may be altered in various ways including amino acid substitutions, deletions, truncations, and insertions. Methods for such manipulations are generally known in the art. For example, amino acid sequence variants and fragments of the sucrose transport polypeptides of the invention can be prepared by mutations in the DNA. Methods for mutagenesis and polynucleotide alterations are well known in the art. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York) and the references cited therein. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be optimal.

Thus, the polynucleotides employed herein include both the naturally occurring sequences as well as mutant forms. Likewise, the polypeptides of the invention encompass naturally occurring polypeptides as well as variations and modified forms thereof. Such variants will continue to possess sucrose transport activity as described herein, influence oil accumulation, or have DGAT, ODP-1 or Lec1 activity. Obviously, the mutations that will be made in the DNA encoding the variant must not place the sequence out of reading frame and optimally will not create complementary regions that could produce secondary mRNA structure. See, EP Patent Application Publication No. 75,444.

The deletions, insertions, and substitutions of the sucrose transporters or the sequences that influence fatty acid accumulation (i.e., the SUT2, SUT4, DGAT, lec1 and ODP1 sequences) encompassed herein are not expected to produce radical changes in the characteristics of the polypeptide. However, when it is difficult to predict the exact effect of the substitution, deletion, or insertion in advance of doing so, one skilled in the art will appreciate that the effect will be evaluated by routine screening assays. That is, the activity can be evaluated by functional assays of sucrose transporter genes. See, for example, Example 2 of the invention as described herein below. Methods of evaluating oil content are described in Examples 7, 8, 14, 15 and 16.

Variant polynucleotides and polypeptides also encompass sequences and polypeptides derived from mutagenic and recombinogenic procedures such as DNA shuffling. With such a procedure, one or more different sucrose transporter coding sequences can be manipulated to create new sucrose transporter polypeptides possessing the desired properties. In this manner, libraries of recombinant polynucleotides are generated from a population of related sequence polynucleotides comprising sequence regions that have substantial sequence identity and can be homologously recombined in vitro or in vivo. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

A "high oil plant" is defined as a transgenic plant having higher oil content when compared to a non-transgenic or null segregant plant. The transgenic plant comprises in its genome at least one recombinant DNA construct comprised of a polynucleotide operably linked to at least one regulatory element. The polynucleotide can encode a protein that is involved in fatty acid accumulation. Examples of such a protein include, but are not limited to: DGAT, Lec1 and ODP1 transcription factor. Alternatively, expression of the polynucleotide can result in silencing of an expressed gene resulting in fatty acid accumulation. Examples of said gene include, but are not limited to, phosphoglucomutase (PGM).

A high oil plant can be obtained by various ways, examples of which include, but are not limited to: selection of naturally occurring allelic variant plants that consistently exhibit oil content higher than the control, mutagenesis followed by selection based on increase in oil content above the control plants, and any manipulation that induces or represses activity of a gene that results in a high oil plant.

The plant with naturally occurring allelic variants for high oil phenotype can be, but is not limited to, *Arabidopsis* (Hobbs et al., *Plant Physiology* (2004) 136(2): 3341-3349), corn (U.S. application Ser. No. 11/680,922; Zheng et al., (2008) Nature Genetics, 40(3); 367-372), canola (Delourme et al., (2006) *Theoretical and Applied Genetics* 113(7): 1331-1345), and soybean (Panthee et al., (2005) *Crop Science* 45(5): 2015-2022).

In the context of this invention, a high oil line is any plant that when a sucrose transporter is overexpressed, a further increase of oil results as compared to a plant that does not have overexpression of a sucrose transporter gene.

A high oil plant can include any plant with an increase in the level of oil in the plant or plant part, for example, in the seed or kernel and/or the embryo or germ, or any combination thereof. For example, increased oil content can comprise an increase in overall oil level in the plant or plant part of about 0.1%, 0.5%, 1%, 5%, 10%, 20%, 30%, 40%, 50%, 60%, 70%, 80%, 90%, 100%, 120%, or greater when compared to a control plant or plant part. Alternatively, the increased level of oil can include about a 0.5-fold, 1-fold, 2-fold, 4-fold, 8-fold, 16-fold, 32-fold, or greater overall increase in oil level in the plant or the plant part when compared to a control plant or plant part. See, U.S. application Ser. No. 11/680,922, herein incorporated by reference in its entirety.

"Diacylglycerol acyltransferase" or "DGAT" is an integral membrane protein that catalyzes the final enzymatic step in the production of triacylglycerols in plants, fungi and mammals. This enzyme is responsible for transferring an acyl group from acyl-coenzyme-A to the sn-3 position of 1,2-diacylglycerol ("DAG") to form triacylglycerol ("TAG"). DGAT is associated with membrane and lipid body fractions in plants and fungi, particularly, in oilseeds where it contributes to the storage of carbon used as energy reserves. DGAT is known to regulate TAG structure and direct TAG synthesis. Furthermore, it is known that the DGAT reaction is specific for oil synthesis. Active variants and fragments of a DGAT polypeptide when expressed in a plant or plant seed will therefore increase the oil content of a plant seed.

Two different families of DGAT proteins have been identified. The first family of DGAT proteins ("DGAT1") is related to the acyl-coenzyme A:cholesterol acyltransferase ("ACAT") and has been described in U.S. Pat. Nos. 6,100,077 and 6,344,548, both of which are herein incorporated by reference. A second family of DGAT proteins ("DGAT2") is unrelated to the DGAT1 family and is described in PCT Patent Publication WO 2004/011671 published Feb. 5, 2004 and herein incorporated by reference. Other references to DGAT genes and their use in plants include PCT Publication No. WO1998/055,631 and U.S. Pat. No. 6,822,141, each of which is herein incorporated by reference.

"DGAT" and diacylglycerol acyltransferase are used interchangeably herein and refer to any member, or combination, of the DGAT1 or DGAT2 family of proteins.

Plant and fungal DGAT genes have been described previously (U.S. Pat. Nos. 7,198,937 and 7,465,565, US Publication No. 2008/0295204, U.S. application Ser. Nos. 12/470,569 and 12/470,517). Each of these references is herein incorporated by reference. Non-limiting examples of DGAT sequences and active variant thereof from *Yarrowia lipolytica* are set forth in SEQ ID NO: 127 and 179-191.

Leafy cotyledon1 or Lec1/Hap3 is a key regulator of seed development in plants. Lec1 is a CCAAT-binding factor (CBF)-type transcription factor. The terms leafy cotyledon 1, Hap3, Lec1, and Hap3/Lec1 are used interchangeably herein and refer to a class of transcription factors. U.S. Pat. No. 6,235,975 describes leafy cotyledon1 genes and their uses. A pending US patent application (U.S. application Ser. No. 11/899,370) relates to isolated nucleic acid fragments encoding Lec1 related transcription factors. Issued patent (U.S. Pat. No. 7,294,759) describes the use of Lec1 genes for altering oil content in plants. Each of these applications is herein incorporated by reference in their entirety. In *Arabidopsis*, Lec1 has been shown to regulate the expression of fatty acid biosynthetic genes (Mu et al., Plant *Physiology* (2008) 148: 1042-1054).

Both starch and fatty acid biosynthesis occur in plastids. These biosynthetic pathways compete for the same precursors such as glucose-6-phosphate. Phosphoglucomutase (PGM) that facilitates the interconversion of glucose-6-phosphate (G6P) and glucose-1-phosphate is an important regulator of these pathways (Periappuram et al., (2000) *Plant Physiol.* 122:1193-1199). Also there are plastidic and cytosolic forms of phosphoglucomutase and both catalyze the conversion of glucose-6-phosphate to glucose 1-phosphate in different subcellular locations.

Previous reports on a plastidic PGM mutant (pgm-1) from the oilseed plant *Arabidopsis* (Caspar et al., (1985) *Plant Physiol.* 79:11-17; Periappuram et al., (2000) *Plant Physiol.* 122:1193-1199) indicated that pgm-1 mutant plants showed a decrease in seed lipid content an increase in leaf soluble carbohydrates. High levels of soluble carbohydrates were also observed in starchless *Nicotiana sylvestris* plants deficient in the plastidic PGM activity (Huber and Hanson, (1992) *Plant Physiol.* 99:1449-1454). Yet another effect of reduced starch content on carbon partitioning was observed in pea (*Pisum sativum*). Seeds from wild type pea typically contain 60% of the seed dry weight as starch. The rug3 locus of *Pisum sativum* encodes the pea plastidic phosphoglucomutase. Pea seeds, of the rug3rug3 genotype, substantially lacking plastidic phosphoglucomutase activity, have a wrinkled phenotype, higher levels of sucrose and an increased lipid content at maturity (EP No. 1001029A1; Casey et al., (1998) *Plant Physiol.* 152: 636-640).

Issued U.S. Pat. Nos. 7,250,557 and 7,323,560 respectively describe isolated plastidic phosphoglucomutase nucleic acids and methods of use of these nucleic acids in altering oil content in plants. Also, U.S. application Ser. No. 12/470,509 describes transgenic plants with altered DGAT and PGM expression profiles to achieve increased oil content and different fatty acid expression profiles. Each of these references is herein incorporated by reference in their entirety.

Ovule Development Protein (ODP) is a transcription factor containing two AP2 domains. AP2 transcription factors (herein referred to interchangeably as "AP2 domain transcription factors", "AP2 proteins", or "AP2 transcription factor proteins") such as ODP, activate several genes in the oil or TAG biosynthetic pathway in the plant cell. USPRV 61/165,548 describes the use of an ODP-1 gene for alteration of oil traits in plants, U.S. Pat. No. 7,579,529 describes an AP2 domain transcription factor and methods of its use. U.S. Pat. No. 7,157,621 discloses the use of ODP transcription factor for increasing oil content in plants. Each of these references is herein incorporated by reference in their entirety.

The terms "triacylglycerol", "oil" and "TAGs" refer to neutral lipids composed of three fatty acyl residues esterified to a glycerol molecule (and such terms will be used interchangeably throughout the present disclosure herein). Such oils can contain long chain PUFAs, as well as shorter saturated and unsaturated fatty acids and longer chain saturated fatty acids. Thus, "oil biosynthesis" generically refers to the synthesis of TAGs in the cell.

"Sucrose transporters" (SUTs) are polynucleotides that encode a class of sucrose/H+ symporters that facilitate transport of sucrose across plant membranes in various plant tissues. Sucrose transporters are present in many plants including, but not limited to, maize, spinach, potato, tomato, pea, *Arabidopsis*, celery, grape, tobacco, *Lotus*, broad bean, and rice (for a review see Kuhn, C. (2003) *Plant biol.* 5:215-232; Allen et al. U.S. Pat. No. 7,288,645). The terms "sucrose transporter" and SUT are used interchangeably herein. Three subfamilies of SUTs are known in plants. The SUT1 subfamily is defined as high affinity, low capacity transporters; the SUT2 subfamily is defined as low affinity or very low affinity, high capacity transporters; and, the SUT4 subfamily is defined as medium or low affinity, high capacity transporters (Roselle et al. (2002) *The Plant Journal* 30(2): 165-175; Kuhn, C. (2003) *Plant biol.* 5:215-232; Sauer, N. (2007) *FEBS Letters* 581:2309-2317; Lalonde et al. (2004) Ann. Rev. Plant Biol. 55:341-372). The SUT1 subfamily of high affinity transporters is not relevant to this invention. AtSUT2 is a member of the SUT2 group (Schulze et al. (2000) *FEBS Letters* 485: 189-194). The SUT4 group, of which AtSUT4 is a member, are low affinity transporters which are expressed in sink tissues and may function in phloem loading within source tissues (Weise et al. (2000) *The Plant Cell* 12:1345-1355). Active variants and fragments of sucrose transporters will retain the ability to transport sucrose.

Others refer to sucrose transporters based on substrate affinity values. Herein, sucrose transporters are further classified based on phylogenetic tree analysis. One example of phylogenetic tree analysis can be found in Kuhn (Kuhn, C, *Plant biol* (2003) 5: 215-232).

Overexpression of sucrose transporters in seeds affects seed development and results in increased carbon flux into developing cotyledons (Roselle et al. (2002) *The Plant*

Journal 30(2):165-175; Rosche et al. (2005) *Functional Plant Biology* 32: 997-1007). In addition, studies have shown that heterologous expression of sucrose transporters results in increased sucrose uptake (Leggewie et al. (2003) *Planta* 217: 158-167).

Methods and compositions relating to the overexpression of sucrose transporters (such as SUT2 or SUT4 sucrose transporters) in high oil plants are provided. In one embodiment, a high oil plant comprising recombinant DNA constructs that overexpress SUT2 or SUT4 sucrose transporters which further increase plant seed oil production compared to a high oil plant comprising recombinant DNA constructs that do not overexpress SUT2 or SUT4 transporters and do not further increase plant seed oil production is provided. Overexpression of SUT2 or SUT4 sucrose transporters in a high oil plant resulting in further increase in oil production provides a significant advantage in the state of the art.

It is well understood by those skilled in the art that different promoters may direct the expression of a gene in different tissues or cell types, or at different stages of development, or in response to different environmental conditions. A number of promoters can be used in recombinant DNA constructs to overexpress sucrose transporters and/or the sequences that influence fatty acid accumulation (i.e., DGAT, lec1 and ODP1 sequences) in plants. In particular embodiments of the invention, these promoters include, but are not limited to, the *Glycine max* annexin promoter (Kinney and Liu, U.S. Pat. No. 7,129,089), the *Glycine max* glycinin Gy1 promoter (WO Patent No. 2004/071467), *Glycine max* β-conglycinin α'-subunit (Beachy et al., EMBO J. 4:3047-3053 (1985), *Glycine max* kunitz trypsin inhibitor (Jofuku et al., Plant Cell 1: 1079-1093 (1989), *Glycine max* albumin 2S (U.S. Pat. No. 6,177,613), *Pisum sativum* legumin A1 (Rerie et al., Mol. Gen. Genet. 225: 148-157 (1991)), *Glycine max* β-conglycinin β-subunit (WO 2004/071467), *Glycine max* BD30 (also called P34) (U.S. Pat. No. 7,129,089), and *Pisum sativum* legumin A2 (Rerie et al., Mol. Gen. Genet. 225:148-157 (1991)). Each of these references is herein incorporated by reference in their entirety.

A recombinant construct can further comprise a terminator sequence operably linked to the polynucleotide of interest. Terminators include, but are not limited to, bean phaseolin 3' terminator (WO 2004/071467), *Glycine max* Myb2 3' (U.S. application Ser. No. 12/486,793), *Glycine max* kunitz trypsin inhibitor 3' (WO 2004/071467), *Glycine max* BD30 (also called P34) 3' (WO 2004/071467), *Pisum sativum* legumin A2 3' (WO 2004/071467), and *Glycine max* albumin 2S 3' (WO 2004/071467).

For instance, PCT Publication No. WO 2004/071467 and U.S. Pat. No. 7,129,089 describe the isolation of a number of promoter and transcription terminator sequences for use in embryo-specific expression in soybean. Furthermore, PCT Publication Nos. WO 2004/071467 and U.S. Pat. No. 7,129,089 describe the synthesis of multiple promoter/gene/terminator cassette combinations by ligating individual promoters, genes, and transcription terminators together in unique combinations. Generally, a NotI site flanked by the suitable promoter (promoters include, but are not limited to, *Glycine max* annexin promoter (Kinney and Liu, U.S. Pat. No. 7,129,089), the *Glycine max* glycinin Gy1 promoter (WO Patent No. 2004/071467), *Glycine max* β-conglycinin α' subunit (Beachy et al., EMBO J. 4:3047-3053 (1985), *Glycine max* kunitz trypsin inhibitor (Jofuku et al., Plant Cell 1: 1079-1093 (1989), *Glycine max* albumin 2S (U.S. Pat. No. 6,177,613), *Pisum sativum* legumin A1 (Rerie et al., Mol. Gen. Genet. 225: 148-157 (1991)), *Glycine max* β-conglycinin β-subunit (WO 2004/071467), *Glycine max* BD30 (also called P34) (U.S. Pat. No. 7,129,089), and *Pisum sativum* legumin A2 (Rerie et al., Mol. Gen. Genet. 225: 148-157 (1991)) and a transcription terminator (transcription terminators include, but are not limited to, bean phaseolin 3' terminator (WO 2004/071467), *Glycine max* Myb2 3' (U.S. application Ser. No. 12/486,793), *Glycine max* kunitz trypsin inhibitor 3' (WO 2004/071467), *Glycine max* BD30 (also called P34) 3' (WO 2004/071467), *Pisum sativum* legumin A2 3' (WO 2004/071467), and *Glycine max* albumin 2S 3' (WO 2004/071467) is used to clone the desired gene. NotI sites can be added to a gene of interest using PCR amplification with oligonucleotides designed to introduce NotI sites at the 5' and 3' ends of the gene. The resulting PCR product is then digested with NotI and cloned into a suitable promoter/NotI/terminator cassette. Although gene cloning into expression cassettes is often done using the NotI restriction enzyme, one skilled in the art can appreciate that a number of restriction enzymes can be utilized to achieve the desired cassette. Further, one skilled in the art will appreciate that other cloning techniques including, but not limited to, PCR-based or recombination-based techniques can be used to generate suitable expression cassettes.

In addition, WO 2004/071467 and U.S. Pat. No. 7,129,089 describe the further linking together of individual promoter/gene/transcription terminator cassettes in unique combinations and orientations, along with suitable selectable marker cassettes, in order to obtain the desired phenotypic expression. Although this is done mainly using different restriction enzymes sites, one skilled in the art can appreciate that a number of techniques can be utilized to achieve the desired promoter/gene/transcription terminator combination or orientations. In so doing, any combination and orientation of embryo-specific promoter/gene/transcription terminator cassettes can be achieved. One skilled in the art can also appreciate that these cassettes can be located on individual DNA fragments or on multiple fragments where co-expression of genes is the outcome of co-transformation of multiple DNA fragments.

It is recognized that other promoters may be used in recombinant DNA constructs to over-express sucrose transporters and/or other polypeptides of the invention in plants. Such promoters can be the native promoter of the polynucleotides (i.e., to the sucrose transporters or to the sequence whose expression influence oil accumulation, DGAT, Lec1 or ODP-1), or they may be selected based on the desired outcome. Thus, nucleic acids of the invention can be combined with constitutive, tissue-preferred, or other promoters for expression in plants.

Such constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

"Seed-preferred" promoters include both "seed-specific" promoters (those promoters active during seed development such as promoters of seed storage proteins) as well as "seed-germinating" promoters (those promoters active during seed germination). See Thompson et al. (1989) *BioEssays* 10:108, herein incorporated by reference. Such seed-preferred promoters include, but are not limited to, Cim1 (cytokinin-induced message); eZ19B1 (maize 19 kDa zein); milps (myo-inositol-1-phosphate synthase) (see WO 00/11177 and U.S. Pat. No. 6,225,529; herein incorporated by reference). Gamma-zein is an endosperm-specific promoter. Globulin 1 (Glb-1) is a representative embryo-specific promoter. For dicots, seed-specific promoters include, but are not limited to, bean β-phaseolin, napin, β-conglycinin, soybean lectin, cruciferin, and the like. For monocots, seed-specific promoters include, but are not limited to, maize 15 kDa zein, 22 kDa zein, 27 kDa zein, gamma-zein, waxy, shrunken 1, shrunken 2, Globulin 1, etc. See also WO 00/12733, where seed-preferred promoters from end1 and end2 genes are disclosed; herein incorporated by reference.

Compositions provided include plants, plant cells, and plant seeds having incorporated into their genomes a first recombinant or heterologous DNA construct and a second recombinant or heterologous DNA construct. The first DNA construct comprises a first polynucleotide operably linked to at least one regulatory element, wherein said polynucleotide when expressed results in increased oil in the plant. The second DNA construct comprises a second polynucleotide operably linked to at least one regulatory element, wherein the second polynucleotide encodes a polypeptide that is a SUT4 or SUT2 sucrose transporter or an active variant or fragment thereof. The plant seeds from such plants exhibit an increased oil content when compared to a plant seed that does not comprise the second polynucleotide encoding the SUT4 or SUT2 sucrose transporter or an active variant or fragment thereof.

In one embodiment, the first polynucleotide which when expressed results in increased oil content in the plant comprises a sequence encoding a DGAT polypeptide or an active variant or fragment thereof, including but not limited to a sequence encoding a DGAT1 polypeptide and/or a DGAT2 polypeptide and the second polynucleotide encodes a SUT4 and/or SUT2 sucrose transporter. Non-limiting examples of DGAT sequences that can be used are set forth in Table 1 and Table 5 or active fragments or variants thereof. In still further embodiments, the DGAT sequence employed comprises a polynucleotide encoding a polypeptide having at least 80%, 85%, 90%, 91%, 92%, 93%, 94%, 95%, 96%, 97%, 98%, or 99% sequence identity to the DGAT sequences set forth in any one of SEQ ID NOS: 180, 182, 184, 186, 188, 190 or 191. Such sequences will continue to have DGAT activity and thus increase the oil content of a seed when expressed the seed or the plant. In such embodiments, the second polynucleotide may comprise a polynucleotide encoding a SUT2 and/or SUT4 polypeptide or an active variant or fragment thereof. Non-limiting examples of SUT2 or SUT4 polypeptide are set forth in Table 1. Thus, the SUT2 and/or SUT4 polypeptides employed can comprises a polynucleotide encoding a polypeptide having at least 80%, 85%, 90%, 91%, 92%, 93%, 94%, 95%, 96%, 97%, 98%, or 99% sequence identity to the SUT2 or SUT4 sequences set forth in any one of SEQ ID NOS: 4, 6, 34, 36, 38, 40-50, 52-83, 85, 150, and/or 178. Such sequences will continue to have SUT2 or SUT4 activity (i.e., transport sucrose). The plant seeds from such plants exhibit an increased oil content when compared to a plant seed that does not comprise the second polynucleotide encoding the SUT4 or SUT2 sucrose transporter.

In a further non-limiting enibodiment, the plant, plant seed, or plant cell comprises a first polynucleotide encoding a DGAT polypeptide having at least 85%, 90%, 91%, 92%, 93%, 94%, 95%, 96%, 97%, 98%, or 99% sequence identity sequence identity to SEQ ID NO: 180, 182, 184, 186, 188, 190 or 191, and the second polynucleotide encodes a sucrose transporter polypeptide having an amino acid sequence of at least 85%, 90%, 91%, 92%, 93%, 94%, 95%, 96%, 97%, 98%, or 99% sequence identity when compared to SEQ ID NOs: 38, 40, 34, 6, and/or 4. Such sequences will continue to have DGAT activity and thus increase the oil content of a seed when expressed the seed or the plant and will continue to have SUT2 or SUT4 activity i.e., transport sucrose), respectively.

The plant seeds from such plants exhibit an increased oil content when compared to a plant seed that does not comprise the second polynucleotide encoding the SUT4 or SUT2 sucrose transporter.

Further compositions provided include plants, plant cells, and plant seeds having incorporated into their genomes a first and a second recombinant or heterologous DNA construct, wherein the first polynucleotide encodes a Lec1 polypeptide or an active variant or fragment thereof, and the second polynucleotide encodes a SUT2 and/or a SUT4 polypeptide or an active variant or fragment thereof, including, but not limited to, the SUT4 and SUT2 polypeptides disclosed in Table 1. Thus, in specific embodiments, the SUT2 and/or SUT4 polypeptides employed can comprises a polynucleotide encoding a polypeptide having at least 80%, 85%, 90%, 91%, 92%, 93%, 94%, 95%, 96%, 97%, 98%, or 99% sequence identity to the SUT2 or SUT4 sequences set forth in any one of SEQ ID NOS: 4, 6, 34, 36, 38, 40-50, 52-83, 85, 150, and/or 178. The plant seeds from such plants exhibit an increased oil content when compared to a plant seed that does not comprise the second polynucleotide encoding the SUT4 or SUT2 sucrose transporter. Such sequences will continue to have SUT2 or SUT4 activity (i.e., transport sucrose).

Further compositions provided include plants, plant cells, and plant seeds having incorporated into their genomes a first and a second recombinant or heterologous DNA construct, wherein the first polynucleotide comprises a polynucleotide encoding an ODP-1 polypeptide or an active variant or fragment thereof, and the second polynucleotide encodes a SUT2 and/or a SUT4 polypeptide or active variant or fragment thereof, including, but not limited to, the SUT4 and SUT2 polypeptides disclosed in Table 1. Thus, in specific embodiments, the SUT2 and/or SUT4 polypeptides employed can comprises a polynucleotide encoding a polypeptide having at least 80%, 85%, 90%, 91%, 92%, 93%, 94%, 95%, 96%, 97%, 98%, or 99% sequence identity to the SUT2 or SUT4 sequences set forth in any one of SEQ ID NOS: 4, 6, 34, 36, 38, 40-50, 52-83, 85, 150, and/or 178. Such sequences will continue to have SUT2 or SUT4 activity (i.e., transport sucrose). The plant seeds from such plants exhibit an increased oil content when compared to a plant seed that does not comprise the second polynucleotide encoding the SUT4 or SUT2 sucrose transporter.

Still further compositions provided include plants, plant cells, and plant seeds having incorporated into their genomes a first and a second recombinant or heterologous DNA construct, wherein the first polynucleotide, when expressed result in silencing of an expressed gene resulting in fatty acid accumulation, including but not limited to, the silencing of phosphoglucorautase, and the second polynucleotide comprises a SUT2 and/or a SUT4 polypeptide or an active variant or fragment thereof, including but not limited to those disclosed in Table 1. The plant seeds from such plants exhibit an increased oil content when compared to a plant seed that does not comprise the second polynucleotide encoding the SUT4 or SUT2 sucrose transporter.

As discussed elsewhere herein, any of the plants, plant cells or seeds disclosed herein can be from any plant, including, but not limited to, maize, soybean, sunflower, sorghum, canota, wheat, alfalfa, cotton, rice, barley, millet, sugar cane or switchgrass.

Methods are provided for further increasing oil content in a high oil plant seed. The Methods comprises (a) introducing into a regenerable high oil plant cell a recombinant DNA construct comprising a polynucleotide operably linked to at least one regulatory sequence, wherein the polynucleotide encodes a potypeptide that is a SUT4 and/or SUT2 sucrose transporter polypeptide or an active variant or fragment thereof; (b) regenerating a transgenic plant from the regenerable plant cell, where the transgenic plant comprises in its genome the recombinant DNA construct; (c) obtaining a progeny plant derived the transgenic plant, where the progeny plant comprises in its genome the recombinant DNA construct and exhibits increased oil content when compared to a plant not comprising the recombinant DNA construct.

In such methods, any polynucleotide encoding a SUT2 and/or SUT4 polypeptide set forth in Table 1, or active variants or fragments thereof can be employed. For example, in one embodiment, the recombinant DNA construct encodes a polypeptide having an amino acid sequence of at least 80%, 85%, 90%, 91%, 92%, 93%, 94%, 95%, 96%, 97%, 98%, or 99% sequence identity, when compared to SEQ ID NOs: 38, 40, 34, 6, 4, 36, 41, 42, 43, 44, 45, 46, 47, 48, 49, 50, 52-83, 85, 150, or 178, wherein said sequence continue to encode a polypeptide having sucrose transporter activity.

In one embodiment, the regenerable high oil plant cell employed in the method comprises a second recombinant DNA construct comprising a sequence that influences fatty acid accumulation, such as, a sequence encoding a diacylglycerol acyltransferase (DGAT) polypeptide or an active variant or fragment thereof, a Lec1 transcription factor polypeptide or an active variant or fragment thereof, or an ODP-1 transcription factor polypeptide or an active variant or fragment thereof.

In one non-limiting method, the regenerable high oil plant cell employed in the method has stably incorporated into its genome a recombinant or heterologous construct comprising a DGAT polypeptide or an active variant or fragment thereof; including but not limited to a sequence encoding a DGAT1 polypeptide or a DGAT2 polypeptide. Non-limiting examples of DGAT sequences that can be present in the regenerable high oil plant cell include those set forth in Table 1 and Table 5 or an active fragments or variants thereof. In still further embodiments, the DGAT sequence employed comprises a polynucleotide encoding a polypeptide having at least 80%, 85%, 90%, 91%, 92%, 93%, 94%, 95%, 96%, 97%, 98%, or 99% sequence identity to the DGAT sequences set forth in any one of SEQ ID NOS: 180, 182, 184, 186, 188, 190, or 191. Such sequences will continue to have DGAT activity and thus increase the oil content of a seed when expressed the seed or the plant.

Further provided is a method of evaluating increased oil content in a plant seed. The method comprises (a) obtaining a transgenic plant, wherein the transgenic plant comprises in its genome a recombinant or heterologous DNA construct comprising a polynucleotide operably linked to at least one regulatory element, wherein the polynucleotide encodes a SUT4 or SUT2 polypeptide or an active variant or fragment thereof; (b) obtaining a progeny plant derived from the transgenic plant, where the progeny plant comprises in its genome the recombinant DNA construct; (c) obtaining seed from the progeny plant; and (d) evaluating the seed for increased oil content compared to a plant seed not comprising the recombinant or heterologous DNA construct.

In such methods, any polynucleotide encoding a SUT2 and/or SUT4 polypeptide set forth in Table 1, or active variants or fragments thereof can be employed. For example, in one embodiment, the recombinant DNA construct encodes a polypeptide having an amino acid sequence of at least 50%, 80%, 85%, 90%, 91%, 92%, 93%, 94%, 95%, 96%, 97%, 98%, or 99% sequence identity, when compared to SEQ ID NOs: 38, 40, 34, 6, 4, 36, 41, 42, 43, 44, 45, 46, 47, 48, 49, 50, 52-83, 85, 150, or 178, wherein said sequence continue to encode a polypeptide having sucrose transporter activity.

In one embodiment, the transgenic plant employed in the method can further comprise a second recombinant or heterologous DNA construct encoding a diacylglycerol acyltransferase (DGAT) polypeptide or an active variant or fragment thereof, a Lec1 transcription factor polypeptide or an active variant or fragment thereof, or an ODP-1 transcription factor polypeptide or an active variant or fragment thereof.

In one non-limiting method, the transgenic plant employed iri the method has stably incorporated into its genome a recombinant or heterologous construct comprising a DGAT polypeptide or an active variant or fragment thereof, including but not limited to a sequence encoding a DGAT1 polypeptide or a DGAT2 polypeptide. Non-limiting examples of DGAT sequences that can be present in the regenerable high oil plant cell include those set forth in Table 1 and Table 5 or an active fragment or variant thereof. In still further embodiments, the DGAT sequence employed comprises a polynucleotide encoding a polypeptide having at least 80%, 85%, 90%, 91%, 92%, 93%, 94%, 95%, 96%, 97%, 98%, or 99% sequence identity to DGAT sequences set forth in any one of SEQ ID NOS: 180, 182, 184, 186, 188, 190, or 191.

As discussed elsewhere herein, any of the methods disclosed herein can employ any plant, including, but not limited to, maize, soybean, sunflower, sorghum, canal, wheat, alfalfa, cotton, rice, barley, millet, sugar cane or switchgrass.

Further provide are isolated polynucleotides and potyptides. Compositions include an an isolated or recombinant polynucleotide comprising: (a) a nucleotide sequence encoding a polypeptide having at least 80%, 85%, 90%, 91%, 92%, 93%, 94%, 95%, 96%, 97%, 98%, 99%, or 100% sequence identity to SEQ ID NOs: 52, 85, 150, or 178, sequences will continue to have sucrose transport activity; or, (b) the complement of the nucleotide sequence, wherein the complement and the nucleotide sequence contain the same number of nucleotides and are 100% complementary. Further provided is an isolated or recombinant polynucleotide which comprising at least 80%, 85%, 90%, 91%, 92%, 93%, 94%, 95%, 96%, 97%, 98%, 99%, or 100% sequence identity the nucleotide sequence of SEQ ID NOs: 51, 84, 149, or 177.

Further provided is a recombinant DNA construct comprising (a) a nucleotide sequence encoding a polypeptide having at least 80%, 85%, 90%, 91%, 92%, 93%, 94%, 95%, 96%, 97%, 98%, 99%, or 100% sequence identity to SEQ ID NOs: 52, 85, 150, or 178; (b) the complement of the nucleotide sequence, wherein the complement and the nucleotide sequence contain the same number of nucleotides and are 100% complementary; or (c) a nucleotide sequence comprising at least 80%, 85%, 90%, 91%, 92%, 93%, 94%, 95%, 96%, 97%, 98%, 99%, or 100% sequence identity the nucleotide sequence of SEQ ID NOs: 51, 84, 149, or 177; wherein the nucleotide sequence is operably linked to at least one regulatory sequence.

Additional compositions include cells, plants, plant cells, and seed comprising a heterologous polynucleotide comprising (a) a nucleotide sequence encoding a polypeptide, having at least 80%, 85%, 90%, 91%, 92%, 93%, 94%, 95%, 96%, 97%, 98%, 99%, or 100% sequence identity to SEQ ID NOs: 52, 85, 150, or 178, wherein the sequences will continue to have sucrose transport activity; (b) the complement of the nucleotide sequence, wherein the complement and the nucleotide sequence contain the same number of nucleotides and are 100% complementary; or (c) a nucleotide sequence comprising at least 80%, 85%, 90%, 91%, 92%, 93%, 94%, 95%, 96%, 97%, 98%, 99%, or 100% sequence identity the nucleotide sequence of SEQ ID NOs: 51, 84, 149, or 177, wherein said sequence encode a polypeptide having sucrose transport activity. In further embodiments, the heterologous polynucleotide can be in a recombinant DNA construct. As discussed elsewhere herein, the cell may be eukaryotic, e.g., a yeast, insect or plant cell, or prokaryotic, e.g., a bacterium. In another embodiment, the plants or seeds derived from said plant wherein the plant is selected from, but not limited to, the group consisting of: maize, soybean, sunflower, sorghum, canola, wheat, alfalfa, cotton, rice, barley, millet, sugar cane and switchgrass.

Further provide are isolated or recombinant polypeptides which comprise an amino acid sequence having at least 80%, 85/0, 90%, 91%, 92%, 93%, 94%, 95%, 96%, 97%, 98%, 99%, or 100% sequence identity to SEQ ID NOs: 52, 85, 150, or 178.

EXAMPLES

The present invention is further illustrated in the following Examples, in which parts and percentages are by weight and degrees are Celsius, unless otherwise stated. It should be understood that these examples, while indicating embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions. Furthermore, various modifications of the invention in addition to those shown and described herein will be apparent to those skilled in the art from the foregoing description. Such modifications are also intended to fall within the scope of the appended claims.

Example 1

Cloning of *Arabidopsis thaliana* Sucrose Transporter Genes

This example describes cloning of *Arabidopsis thaliana* sucrose transporter genes, ATSUC2 (AT1G22710, SEQ ID NO: 1), ATSUT2 (AT2G02860, SEQ ID NO: 3), and ATSUT4 (AT1G09960, SD) ID NO: 5). Total RNA was prepared from 1 month-old *Arabidopsis thaliana* seedlings using TRIzol® Reagent (Invitrogen™, USA) following the manufacturer's protocol. To make first strand cDNA, a reverse transcription reaction was carried out as follows. A mixture (1 μL of 50 μM dTVN, 1 μL dNTP mix (10 μM each), 5 μg of total RNA, and 10 μL of water) was heated at 65° C. for 5 min and immediately placed on ice for 1 min. The reaction mixture was supplemented with 4 μL of 5× reverse transcription buffer, 1 μL of 0.1 M DTT, 1 μL of anti RNase, and SuperScript III Invitrogen™, USA). The reverse transcription reaction was carried out for 1 h at 50° C. The reaction was stopped by incubating at 70° C. for 15 min. Twenty microliters of water was added to the reaction. Synthesized first strand cDNAs were used as templates in subsequent PCR reactions.

The PCR reactions, with the first-strand *Arabidopsis thaliana* cDNAs as template, were individually carried out in 50 μL total volume comprising: 1 μL each of 10 μM forward and reverse primers, 2 μL cDNAs, 5 μL 10×PCR buffer, 1 μL dNTP mix (10 μM each), 39 μL water and 1 μL Expand polymerase (Roche Applied Science, Indianapolis, Ind.). Primers designed and used to introduce a NotI site flanking the gene were YOL237 (SEQ ID NO: 7) and YOL132 (SEQ ID NO: 8) for ATSUC2, YOL174 (SEQ ID NO: 9) and YOL175 (SEQ ID NO: 10) for ATSUT2, and YOL172 (SEQ ID NO: 11) and YOL173 (SEQ ID NO: 12) for ATSUT4. Amplification was carried out at 94° C. for 3 min, followed by 30 cycles at 94° C. for 30 sec, 58° C. for 30 sec, and 72° C. for 2 min, followed by a final elongation cycle at 72° C. for 6 mm. PCR products were gel-purified, cloned into pCRR2.1 (Invitrogen™, USA) using manufacturer instructions and were sequence-verified. The resulting plasmids for each gene were set forth as ATSUC2-pCRR2.1 (SEQ ID NO: 13), ATSUT2-pCRR2.1 (SEQ ID NO: 14), and ATSUT4-pCRR2.1 (SEQ ID NO: 15) respectively.

To aid protein analyses, ATSUC2, ATSUT2, or ATSUT4 with a hexa-histidine tag at the carboxyl terminus (SEQ ID NO: 16; 17; and 18, respectively) was created by PCR reactions as follows. Oligonucleotide primers used were YOL412 (SEQ ID NO: 19) and YOL413 (SEQ ID NO: 20) for ATSUC2, YOL416 (SEQ ID NO: 21) and YOL417 (SEQ ID NO: 22) for ATSUT2, and YOL414 (SEQ ID NO: 23) and YOL415 (SEQ ID NO: 24) for ATSUT4. Primers were designed to have a NotI restriction site flanking the gene. Templates were respective plasmids carrying the identical sucrose transporter genes either as in ATSUC2 (AT1G22710, SEQ ID NO: 1), ATSUT2 (AT2G02860 SEQ ID NO: 3), or ATSUT4 (AT1G09960, SEQ ID NO: 5). PCR reaction was carried out in a 50 μL total volume comprising: 1 μL each of 10 μM respective primers, 1 μL template DNA (100 ng), 10 μL 5×PCR buffer, 1 μL dNTP mix (10 μM each), 36 μL water and 0.5 μL Phusion polymerase (New England Biolabs, Inc., Ipswich, Mass.). Amplification was carried out at 98° C. for 30 sec, followed by 30 cycles at 98° C. for 10 sec, 55° C. for 15 sec, and 72° C. for 30 sec, followed by a final elongation cycle at 72° C. for 6 min. PCR products were gel-purified and cloned into pCRR4BLUNT-TOPOR (Invitrogen) using manufacturer instructions. Based on sequencing analyses, the plasmids with the consensus sequences were set forth as RTW155 (ATSUC2HIS6) (SEQ ID NO: 25), RTW156 (ATSUT4HIS6) (SEQ ID NO: 26), and RTW157 (ATSUT2HIS6) (SEQ ID NO: 27).

Example 2

Functional Assays of *Arabidopsis thaliana* Sucrose Transporter Genes in *Saccharomyces cerevisiae*

This example describes functional activity assays of *Arabidopsis thaliana* sucrose transporters in an invertase-deleted yeast strain (see on the World Wide Web at http://www-sequence.stanford.edu/group/yeast_deletion_project/deletions3.html). The method used was based on Sauer and Stolz (*Plant J.* (1994) 6: 67-77) with modification.

Using the yeast expression vector, pY75 (U.S. application Ser. No. 12/126,161 (SEQ ID NO: 3)), yeast expression plasmids containing *Arabidopsis thaliana* sucrose transporters described in Example 1 were constructed and employed in assays after transformation into yeast.

Construction of RTW247 (Yeast ATSUC2HIS):

The construction of plasmid RTW155 (ATSUC2HIS6) is described in Example 1. A fragment containing ATSUC2HIS6 gene was excised from RTW155 with NotI restriction enzyme digestion. This DNA was ligated to NotI linearized, dephosphorylated pY75 vector DNA to give RTW247 (yeast ATSUC2HIS) (SEQ ID NO: 28).

Construction of RYW248 (Yeast ATSUT4HIS):

The construction of plasmid RTW156 (ATSUT4HIS6) is described in Example 1. A fragment containing ATSUT4HIS6 gene was excised from RTW156 with NotI restriction enzyme digestion. This DNA was ligated to NotI linearized, dephosphorylated pY75 vector DNA to give RTW248 (yeast ATSUT4HIS) (SEQ ID NO: 29).

Construction of RTW249 (Yeast ATSUT2HIS):

The construction of plasmid RTW157 (ATSUT2HIS6) is described in Example 1. A fragment containing ATSUT2HIS6 gene was excised from RTW157 with NotI restriction enzyme digestion. This DNA was ligated to NotI linearized, dephosphorylated pY75 vector DNA to give RTW249 (yeast ATSUT2HIS) (SEQ ID NO: 30).

Construction of RTW250 (Yeast ATSUC2):

The construction of plasmid ATSUC2-pCRR2.1 is described in Example 1. A fragment containing ATSUC2 gene was excised from ATSUC2-pCRR2.1 with NotI restriction enzyme digestion. This DNA was ligated to NotI linearized, dephosphorylated pY75 vector DNA to give RTW250 (yeast ATSUC2) (SEQ ID NO: 31).

Construction of RTW251 (Yeast ATSUT4):

The construction of plasmid ATSUT4-pCRR2.1 is described in Example 1. A fragment containing ATSUT4 gene was excised from ATSUT4-pCRR2.1 with NotI restriction enzyme digestion. This DNA was ligated to NotI linearized, dephosphorylated pY75 vector DNA to give RTW251 (yeast ATSUT4) (SEQ ID NO: 32).

Transformation of Yeast

Plasmids RTW247 (yeast ATSUC2HIS), RTW248 (yeast ATSUT4HIS), RTW249 (yeast ATSUT2RIS), RTW250 (yeast ATSUC2), RTW251 (yeast ATSUT4), and the empty pY75 vector were transformed into the *Saccharomyces cerevisiae* strain that has deletion in invertase gene (see on the World Wide Web at http://www.sequence.stanford.edu/group/yeast_deletion_project/deletions3.html) using S. c. EasyComp Transformation Kit (Invitrogen) and manufacturer's instruction. Recombinant yeast colonies were selected on DOB agar plates supplemented with CSM-leu (Qbiogene, Carlsbad, Calif.). DOB media are composed of 1.7 g yeast nitrogen base, 5 g ammonium sulfate, and 20 g Dextrose per liter.

Sucrose Transporter Assays in Yeast

For functional assays of sucrose transporters in yeast, single colony from each transformation was inoculated in 10 mL of DOB media supplemented with CSM-leu and grown at 30° C. for 48 h. This seed culture was used to inoculate the second culture of 40 mL DOB media supplemented with CSM-leu. The culture was incubated at 30° C. for 16 h. After checking cell density at OD575, cells were harvested by centrifugation. Cells were washed by resuspending in culture media composed with DOB supplemented with CSM-leu and 20 mM sucrose, followed by centrifugation. This step was performed twice. After washing, 100 µL of an OD575 culture of cells was added to the final volume of 100 ml of DOB supplemented with CSM-leu and 20 mM sucrose.

Three replicates of each yeast culture were harvested by centrifugation (2,000×g for 10 min) at 1, 2, 3, 4 and 6 hours after culture initiation. The media was discarded and the pelleted cells were re-suspended in 10 mL of deionized water, to remove any residual media. The cells were pelleted again, the supernatant discarded, and the pellets re-suspended in 1 mL deionized water prior to quantitative transfer to pre-weighed 2 mL capacity centrifuge tubes. The samples were frozen in liquid nitrogen and stored at −80° C. prior to lyophilization. The dry samples were re-weighed and the dry weight of the cell pellets (average ~3 mg/culture) was calculated and used to normalize the carbohydrate concentrations (see below).

The dried yeast pellets were suspended in 1 mL 80% aqueous ethanol and, with the tubes in ice, sonicated for 3×30 sec at a 50% power setting using a Vibra-Cell fitted with a Model AS1 probe (Sonics & Materials Inc; Newtown, Conn., USA). The cell debris was pelleted by centrifugation (16,000×g for 10 min) and the supernatants were transferred to clean 1.3×100 mm screw-capped glass tubes fitted with Teflon® lined closures. The pellets were extracted 3 more times with 1 mL volumes of 80% ethanol as follows. After addition of the ethanol the tubes were vortex mixed and placed into an ultrasonic bath (VWR Scientific Model 750D) filled with water heated to 60° C. The samples were sonicated at full-power (~360 W) for 15 min and were then centrifuged (10 min×16,000×g) with the supernatant from each extract pooled with those from the previous extracts. Internal standard (10 µL, β-phenyl glucopyranoside (Sigma-Aldrich P6876); 0.5000+/−0.0010 g/100 mL stock in water) was added to each pooled supernatant prior to drying in a Speedvac.

The dried samples were solubilized in anhydrous pyridine (Sigma-Aldrich P57506) containing 30 mg/mL of hydroxylamine HCl (Sigma-Aldrich 159417). Samples were placed on an orbital shaker (300 rpm) overnight and were then heated for 1 hr (75° C.) with vigorous vortex mixing applied every 15 min. After cooling to room temperature, 1 mL hexamethyldisilazane (Sigma-Aldrich H-4875) and 100 µL trifluoroacetic acid (Sigma-Aldrich T6508) were added. The samples were vortex mixed and the precipitates were allowed to settle prior to transferring the supernatants to GC sample vials.

Samples were analyzed on an Agilent 6890 gas chromatograph fitted with a DB-17MS capillary column (15 m×0.32 mm×0.25 µm film). Inlet and detector temperatures were both 275° C. After injection (2 µL, 20:1 split) the initial column temperature (150° C.) was increased to 180° C. at a rate of 3° C./min and then at 25° C./min to a final temperature of 320° C. The final temperature was maintained for 10 min. The carrier gas was $H_2$ at a linear velocity of 51 cm/sec. Detection was by flame ionization. Data analysis was performed using Agilent ChemStation software. Sucrose was quantified relative to the internal standard and detector responses were applied (calculated from standards run with each set of samples). Final carbohydrate concentrations were expressed on a tissue dry weight basis.

Figure 1:
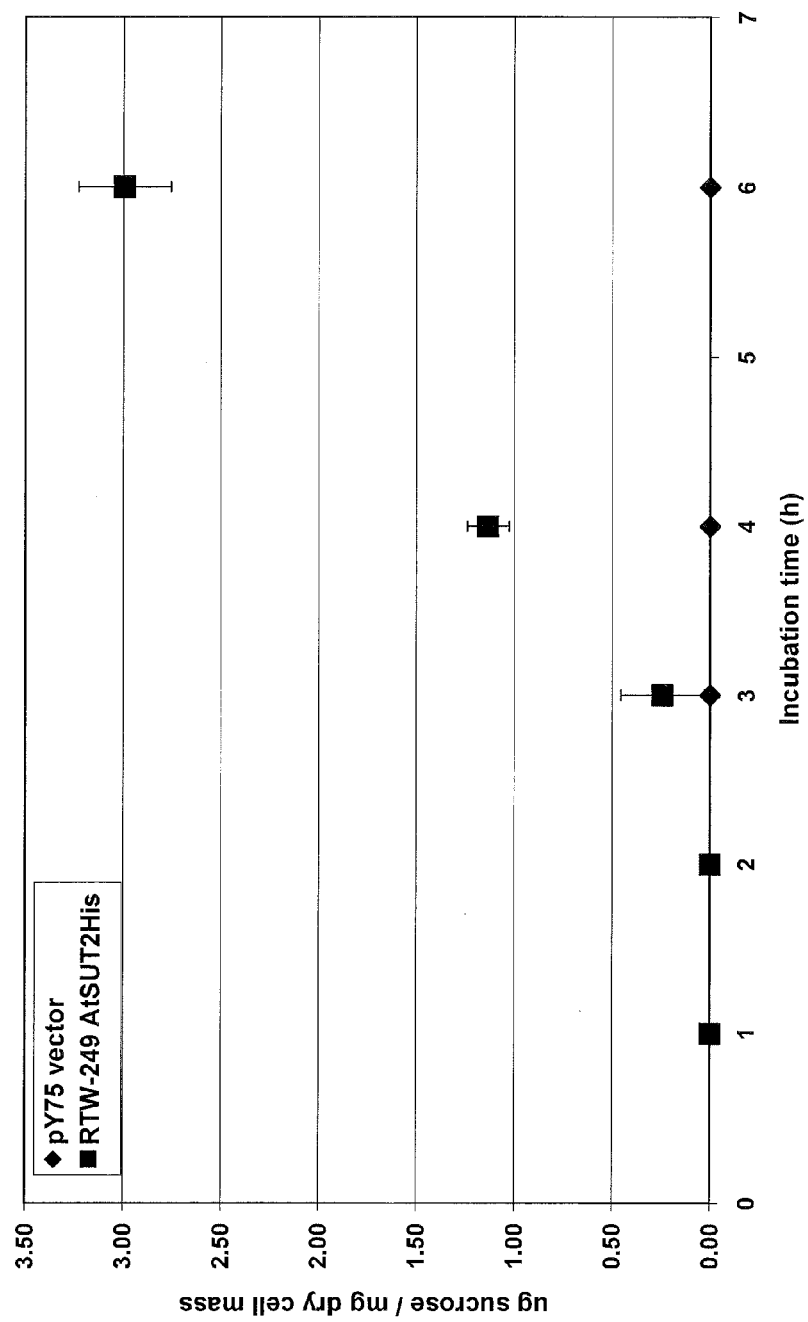
FIG. 1 shows sucrose levels recovered from yeast cells after various times in culture for AtSUT2. Incubation time is shown on the x axis as hours (h) and pg sucrose/mg dry cell mass is shown on the y axis.
Figure 2:
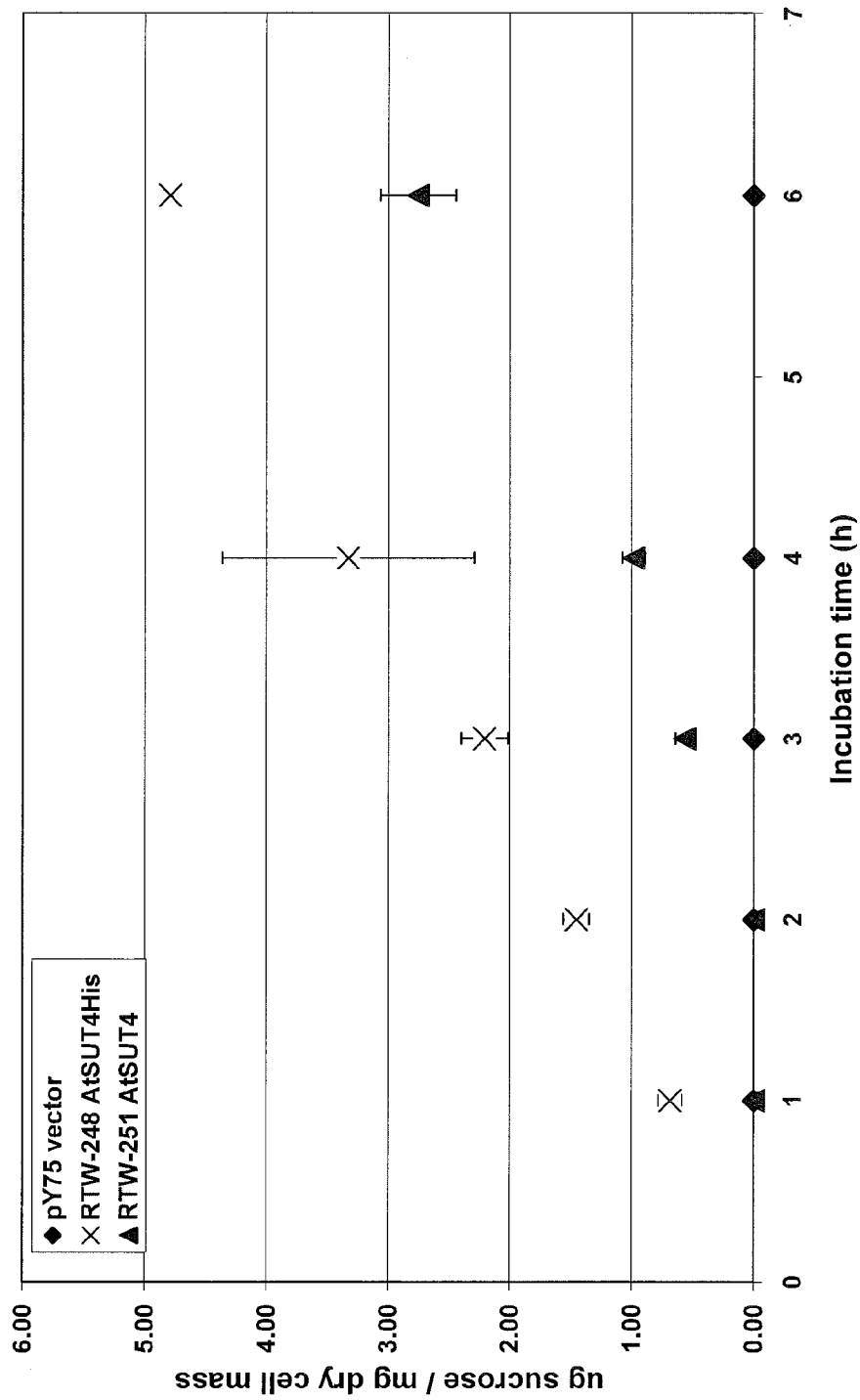
FIG. 2 shows sucrose levels recovered from yeast cells after various times in culture for AtSUT4 and AtSUT4HIS. Incubation time is shown on the x axis as hours (h) and µg sucrose/mg dry cell mass is shown on the y axis.
Figure 3:
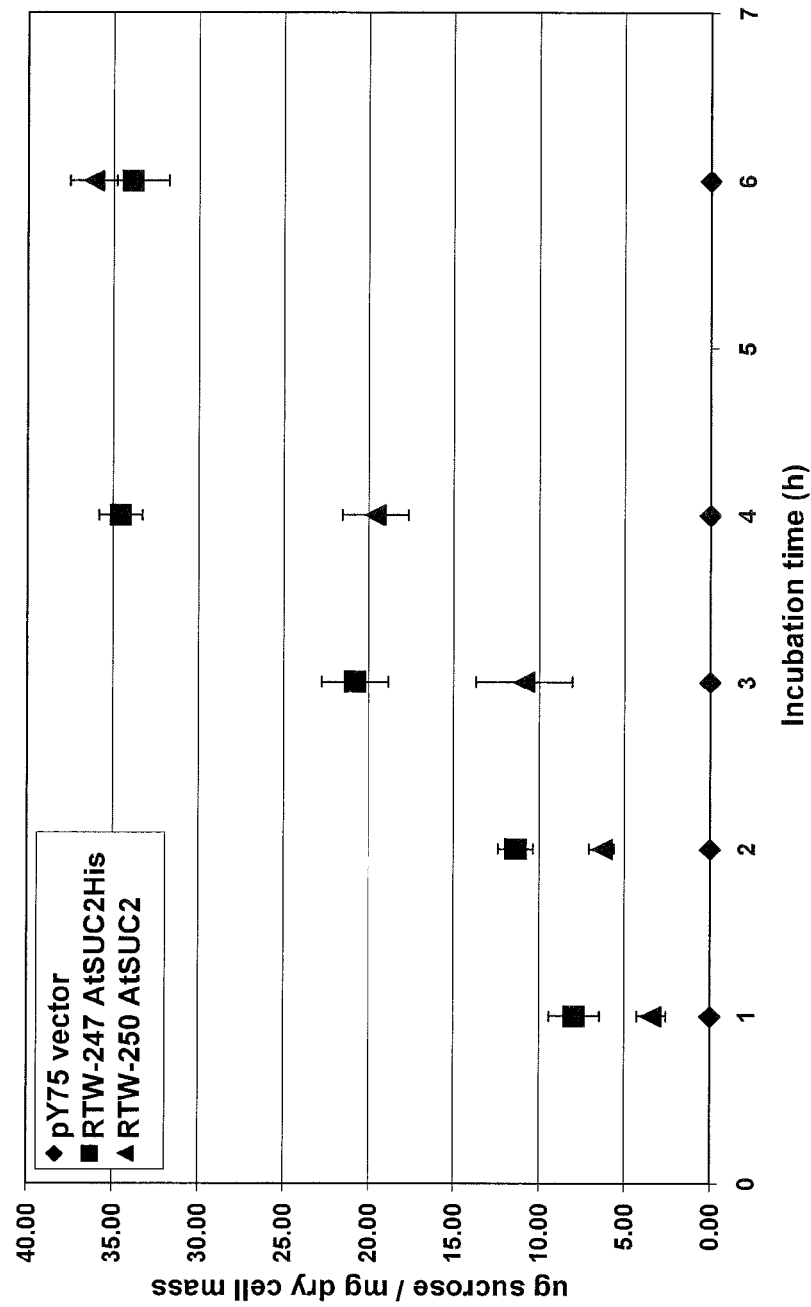
FIG. 3 shows sucrose levels recovered from yeast cells after various times in culture for AtSUC2 and AtSUC2HIS. Incubation time is shown on the x axis as hours (h) and µg sucrose/mg dry cell mass is shown on the y axis.

FIGS. 1-3 present sucrose levels recovered from yeast cells after various times in culture for SUT2 (FIG. 1), SUT4 (FIG. 2), and SUC2 (FIG. 3).

For all three sucrose transporter classes tested, increases in intracellular sucrose levels were observed as the time in culture increased. Yeast cells carrying the empty pY75 vector were used as the control and showed no sucrose accumulation even after 6 hours in culture; growth of the control yeast, as assessed by the dry cell mass at each harvest time, was at least equivalent to the cells expressing the various transporters. All three classes of sucrose transporter retained their capacity to transport sucrose even with the HIS-Tag fused to the carboxy terminus of the protein.

The cloned genes result in the expression of proteins with the apparent capacity to transport sucrose and the proteins retain this ability even when fused with a C-terminal HIS-tag.

Example 3

Identifying Sucrose Transporter Gene Homologs in Soy

Soybean homologs of the *Arabidopsis* Sut2 (SEQ ID NO: 4) and Sut4 (SEQ ID NO: 6) genes were identified by conducting BLAST (Basic Local Alignment Search Tool; Altschul et al., *J. Mol. Biol.* 215:403-410 (1993)) searches for similarity to sequences contained in the Soybean Genome Project, DoE Joint Genome Institute "Glyma1.01." gene set. Specifically, the TBLASTN algorithm provided by National Center for Biotechnology Information (NCBI) was used with default parameters except the Filter Option was set to OFF.

In this way, two soy putative cDNA sequences were identified with homology to *Arabidopsis* Sut2 protein (Glyma08g40980 (SEQ ID NO: 33) and Glyma18g15950 (SEQ ID NO: 35)) and two soy putative cDNA sequences were identified with homology to *Arabidopsis* Sut4 (Glyma02g38300 (SEQ ID NO 37) and Glyma04g09460 (SEQ ID NO 39)).

The SEQ ID NOs for DNA CDS and amino acid sequences of each of the soy Sut homologs as well as the percent identity to the corresponding *Arabidopsis* proteins are shown in Table 2.

Sequence percent identity calculations performed by the Clustal V method (Higgins, D. G. and Sharp, P. M., *Comput. Appl. Biosci.* 5:151-153 (1989); Higgins et al., *Comput. Appl. Biosci.* 8:189-191 (1992)) were done using the MegAlign™ v6.1 program of the LASERGENE bioinformatics computing suite (DNASTAR Inc., Madison, Wis.) with the default parameters for pairwise alignment (KTUPLE=1, GAP PENALTY=3 WINDOW=5 and DIAGONALS SAVED=5 and GAP LENGTH PENALTY=10).

TABLE 2

Soy homologs to the *Arabidopsis* Sut2 and Sut4 genes

| Sut Gene Subfamily | Soy Sut Homolog | Nucleotide (SEQ ID NO:) | Amino Acid (SEQ ID NO:) | % Amino Acid Identity |
|---|---|---|---|---|
| Sut2 | Glyma08g40980 | 33 | 34 | 68.4% |
| Sut2 | Glyma18g15950 | 35 | 36 | 66.4% |
| Sut4 | Glyma02g38300 | 37 | 38 | 66.0% |
| Sut4 | Glyma04g09460 | 39 | 40 | 63.9% |

Example 4

Identification of Sucrose Transporter Homologs

Plant homologs of *Arabidopsis thaliana* SUT1, SUT2 and SUT4 homologs were identified by conducting BLAST (Basic Local Alignment Search Tool; Altschul et al., *J. Mol. Biol.* 215:403-410 (1993); see also the explanation of the BLAST algorithm on the world wide web site for the National Center for Biotechnology Information at the National Library of Medicine of the National Institutes of Health) searches for similarity to amino acid sequences contained in the BLAST "nr" database (comprising all non-redundant GenBank CDS translations, sequences derived from the 3-dimensional structure Brookhaven Protein Data Bank, the last major release of the SWISS-PROT protein sequence database, EMBL, and DDRJ databases). The DNA sequences from clones can be translated in all reading frames and compared for similarity to all publicly available protein sequences contained in the "nr" database using the BLASTX algorithm (Gish and States, *Nat. Genet.* 3:266-272 (1993)) provided by the NCBI. Alternatively, the polypeptides encoded by the cDNA sequences can be analyzed for similarity to all publicly available amino acid sequences contained in the "nr" database using the BLASTP algorithm provided by the National Center for Biotechnology Information (NCBI). For convenience, the P-value (probability) or the E-value (expectation) of observing a match of a cDNA-encoded sequence to a sequence contained in the searched databases merely by chance as calculated by BLAST are reported herein as "pLog" values, which represent the negative of the logarithm of the reported P-value or E-value. Accordingly, the greater the pLog value, the greater the likelihood that the cDNA-encoded sequence and the BLAST "hit" represent homologous proteins.

EST sequences can be compared to the GenBank database as described above. ESTs that contain sequences more 5- or 3-prime can be found by using the BLASTN algorithm (Altschul et al., *Nucleic Acids Res.* 25:3389-3402 (1997)) against the DUPONT proprietary database comparing nucleotide sequences that share common or overlapping regions of sequence homology. Where common or overlapping sequences exist between two or more nucleic acid fragments, the sequences can be assembled into a single contiguous nucleotide sequence, thus extending the original fragment in either the 5 or 3 prime direction. Once the most 5-prime EST is identified, its complete sequence can be determined by Full Insert Sequencing as described above.

Homologous genes belonging to different species can be found by comparing the amino acid sequence of a known gene (from either a proprietary source or a public database) against an EST database using the tBLASTn algorithm. The tBLASTn algorithm searches an amino acid query against a nucleotide database that is translated in all 6 reading frames. This search allows for differences in nucleotide codon usage between different species, and for codon degeneracy.

Table 3 lists *Arabidopsis thaliana* homologs that are described herein, the corresponding identifier (SEQ ID NO) as used in the attached Sequence Listing, the SUT subfamily designation, and species. Sucrose transporters in Table 3 were classified based on the phylogenetic tree from the review article by Kuhn (Kuhn, C, *Plant biol* (2003) 5: 215-232)

TABLE 3

| SUT Family | Sequence Description (NCBI GI NO:) | Species | SEQ ID NO. |
|---|---|---|---|
| SUCROSE TRANSPORTER HOMOLOGS ||||
| SUT2 | AtSUT2 (At2G02860; NCBI GI NO. 973404) | Arabidopsis thaliana | 4 |
| | Glyma08g40980.1 | Glycine max | 34 |
| | Glyma18g15950.1 | Glycine max | 36 |
| | CsSUT2 (NCBI GI NO. 21063927) | Citrus sinensis | 41 |
| | EuSUT2 (NCBI GI NO. 61657989) | Eucommia ulmoides | 42 |
| | StSUT2 (NCBI GI NO. 31096339) | Solanum tuberosum | 43 |
| | LeSUT2 (NCBI GI NO. 10119908) | Lycopersicon esculentum | 44 |
| | LOC_Os02g58080_SUC3 | Oryza sativa | 45 |
| | cfp5n.pk008.k9_fis | Zea mays | 46 |
| | Sb04g038030.1 | Sorghum bicolor | 47 |
| | PmSUT2 (NCBI GI NO. 31455370) | Plantago major | 48 |
| | MeSUT2 (NCBI GI NO. 74476789) | Manihot esculenta | 49 |
| | HbSUT2 (NCBI GI NO. 116008244) | Hevea brasiliensis | 50 |
| | Pn_Node_9230 | Paspalum notatum | 52 |
| | ZmSUT1 (NCBI GI NO. 162463612) | Zea mays | 53 |
| | Sb01g045720.1 | Sorghum bicolor | 54 |
| | cepe7.pk0015.d10 | Zea mays | 55 |
| | TaSUT1A (NCBI GI NO. 20152871) | Triticum aestivum | 56 |
| | TaSUT1b (NCBI GI NO. 20152873) | Triticum aestivum | 57 |
| | TaSUT1D (NCBI GI NO. 19548165) | Triticum aestivum | 58 |
| | HvSUT1 (NCBI GI NO. 71890897) | Hordeum vulgare | 59 |
| | LOC_Os03g07480 | Oryza sativa | 60 |
| | LOC_Os10g26470_SUC1 | Oryza sativa | 61 |
| | Sb01g022430.1 | Sorghum bicolor | 62 |
| | cfp1n.pk007.b22_fis | Zea mays | 63 |
| | LOC_Os02g36700_BoSUT1 | Oryza sativa | 64 |
| | Sb04g023860.1 | Sorghum bicolor | 65 |
| | Sb07g028120.1 | Sorghum bicolor | 66 |
| | BoSUT1(NCBI GI NO. 66269698) | Bambusa oldhamii | 67 |
| | cfp1n.pk065.p4_fis | Zea mays | 68 |
| | cfp3n.pk071.b8_fis | Zea mays | 69 |
| | Pn_Node_40538 | Paspalum notatum | 150 |
| SUT4 | ATSUT4 (At1G09960; NCBI GI NO. 15218362) | Arabidopsis thaliana | 6 |
| | Glyma02g38300.1 | Glycine max | 38 |
| | Glyma04g409460.1 | Glycine max | 40 |
| | PsSUF4 (NCBI GI NO. 78192243) | Pisum sativum | 70 |
| | HbSUT5 (NCBI GI NO. 118132673) | Hevea brasiliensis | 71 |
| | HbSUT4 (NCBI GI NO. 118132677) | Hevea brasiliensis | 72 |
| | MeSUT4 (NCBI GI NO. 74476785) | Manihot esculenta | 73 |
| | VvSUC11 (NCBI GI NO. 6434829) | Vitis vinifera | 74 |
| | StSUT4 (NCBI GI NO. 160425326) | Solanum tuberosum | 75 |
| | DcSUT1a | Daucus carota | 76 |
| | ZmSUT4 (NCBI GI NO. 47571319) | Zea mays | 77 |
| | Sb08g023310.1 | Sorghum bicolor | 78 |
| | LOC_Os12g44380_SUC4_orSUC2 | Oryza sativa | 79 |
| | HvSUT2 (NCBI GI NO. 7024413) | Hordeum vulgare | 80 |
| | MdSUT4 (NCBI GI NO. 38327323) | Malus domestica | 81 |
| | DgSUT4 (NCBI GI NO. 49609488) | Datisca glomerata | 82 |
| | LjSUT4 (NCBI GI NO. 28172870) | Lotus japonicus | 83 |
| | Pn_Node_3980 | Paspalum notatum | 85 |
| | hso1c.pk009.l6:fis | Helianthus annuus | 178 |
| SUT1 | ATSUC8 (At2G14670; NCBI GI NO. 15225986) | Arabidopsis thaliana | 86 |
| | ATSUC7 (At1G66570; NCBI GI NO. 115646796) | Arabidopsis thaliana | 87 |
| | ATSUC6 (At5G43610; NCBI GI NO. 15239921) | Arabidopsis thaliana | 88 |
| | ATSUC9 (At5G06170; NCBI GI NO. 15239949) | Arabidopsis thaliana | 89 |
| | AtSUC2 (At1G22710; NCBI GI NO. 15219938) | Arabidopsis thaliana | 2 |
| | AtSUC1 (At1G71880; NCBI GI NO. 56550707) | Arabidopsis thaliana | 90 |
| | ATSUC5 (At1G71890; NCBI GI NO. 15217602) | | 91 |
| | Glyma02g08250.1 | Glycine max | 92 |
| | se5.pk0033.f9_Glyma16g27320.1 | Glycine max | 93 |
| | PvSUT1 (NCBI GI NO. 78192247) | Phaseolus vulgaris | 94 |
| | sfl1.pk0001.g1_Glyma16g27340_&_27330 | Glycine max | 95 |
| | PvSUT3 (NCBI GI NO. 78192251) | Phaseolus vulgaris | 96 |
| | sgc7c.pk001.n22_Glyma02g08260.1 | Glycine max | 97 |

TABLE 3-continued

SUCROSE TRANSPORTER HOMOLOGS

| SUT Family | Sequence Description (NCBI GI NO:) | Species | SEQ ID NO. |
|---|---|---|---|
| | sls2c.pk003.p4_Glyma16g27350.1 | Glycine max | 98 |
| | PvSUF1 (NCBI GI NO. 125625363) | Phaseolus vulgaris | 99 |
| | SUF1_Ps (NCBI GI NO. 78192245) | Pisum sativum | 100 |
| | sfl1.pk0043.c7_Glyma10g36200.1 | Glycine max | 101 |
| | PsSUT1 (NCBI GI NO. 5230818) | Pisum sativum | 102 |
| | VfSut1 | Vicia faba | 103 |
| | HbSUT1 (NCBI GI NO. 116008246) | Hevea brasiliensis | 104 |
| | HbSUT6 (NCBI GI NO. 167859950) | Hevea brasiliensis | 105 |
| | HbSUT3 (NCBI GI NO. 118132675) | Hevea brasiliensis | 106 |
| | RcScr1 (NCBI GI NO. 468562) | Ricinus communis | 107 |
| | PtSUT1 (NCBI GI NO. 77153413) | Populus tremula x Populus tremuloides | 108 |
| | EeSUT1 (NCBI GI NO. 7649151) | Euphorbia esula | 109 |
| | hss1c.pk009.b12_fis | Helianthus annuus | 110 |
| | vs1n.pk016.e12_fis | Vernonia mespilifolia | 111 |
| | VvSUT27 (NCBI GI NO. 6434833) | Vitis vinifera | 112 |
| | AmSUT1 (NCBI GI NO. 17447420) | Alonsoa meridionalis | 113 |
| | AbSUT1 (NCBI GI NO. 6120115) | Asarina barclaiana | 114 |
| | NtSUT1a (NCBI GI NO. 575351) | Nicotiana tabacum | 115 |
| | StSUT1 (NCBI GI NO. 439294) | Solanum tuberosum | 116 |
| | AgSUT2A (NCBI GI NO. 5566434) | Apium graveolens | 117 |
| | AgSUT1 (NCBI GI NO. 4091891) | Apium graveolens | 118 |
| | DcSUT2 (NCBI GI NO. 2969884) | Daucus carota | 119 |
| | BvSUT1 (NCBI GI NO. 5823000) | Beta vulgaris | 120 |
| | SoS21 (NCBI GI NO. 549000) | Spinacia oleracea | 121 |
| | CsSUT1 (NCBI GI NO. 21063921) | Citrus sinensis | 122 |
| | BoSUC2 (NCBI GI NO. 18091781) | Brassica oleracea | 123 |
| | BoSUC1 (NCBI GI NO. 18091779) | Brassica oleracea | 124 |
| | PmSUC1 (NCBI GI NO. 667047) | Plantago major | 125 |
| | NtSUT3 (NCBI GI NO. 4960089) | Nicotiana tabacum | 126 |

FIG. 4A-G presents an alignment of the amino acid sequences set forth in the SUT2 family and includes SEQ ID NOs: 4, 34, 36, 41-50, 52, and 150. FIG. 5A-F presents an alignment of the amino acid sequences set forth in the SUT2 family and includes SEQ ID NOs: 53-69. FIG. 6A-F presents an alignment of the amino acid sequences set forth in the SUT4 family and includes SEQ ID NOs: 6, 38, 40, 70-83, and 85. FIG. 7 is a chart of the percent sequence identity and the divergence values fir each pair of amino acids sequences presented in FIG. 4A-G. FIG. 8 is a chart of the percent sequence identity and the divergence values for each pair of amino acids sequences presented in FIG. 5A-F, FIG. 9 is a chart of the percent sequence identity and the divergence values for each pair of amino acids sequences presented in FIG. 6A-F.

Sequence alignments and percent identity calculations were performed using the MEGALIGN® program of the LASERGENE® bioinformatics computing suite (DNASTAR® Inc., Madison, Wis.). Multiple alignment of the sequences was performed using the Clustal W method of alignment (Thompson, J. D., et al. (1994). Nucleic Acids Research, 22: 4673-80) with the default parameters (GAP PENALTY=10, GAP LENGTH PENALTY=0.2, DELAY DEVERGENT SEQS (%)=30%, DNA TRANSITION WEIGHT=0.5, PROTEIN WEIGHT MATRIX "Gonnet Series").

Default parameters for pairwise alignments using the Clustal method were SLOW-ACCURATE, GAP PENALTY=1.0, GAP LENGTH=0.10, PROTEIN WEIGHT MATRIX "Gonnet 250"

Sucrose transporter homologs were also identified from an exotic plant species, Paspalum notatum, commonly called Bahia grass and are included in Table 3. One SUT4 homolog, Pn_Node_3980, was identified from Bahia grass (SEQ ID NO: 85) and two SUT2 homologs, Pn_Node_9230 (SEQ ID NO: 52) and Pn_Node_40538 (SEQ ID NO: 150), were also identified from Bahia grass. Mining of homologs from Bahia grass was performed by performing a TblastN of the Arabidopsis Sut2 and Sut4 genes, and the identified (putative) maize Sut2 and Sut4 homologs against the Bahia assemblies. The resulting hits were translated based on the blast alignments; and the translations were aligned with the other known sucrose transporters. In cases where the Bahia assemblies were in fragments, the percent identity to the maize genes was used to infer which Bahia fragments represented a single gene. The fragments thought to belong together were computationally assembled such that a translation would return the correct protein in a single frame. These computer assemblies were then aligned with the other transporters as above.

Example 5

Phylogenetic Analysis of SUT1, SUT2, and SUT4

FIG. 10 present phylogenetic analysis of the SUT1, SUT2, and SUT4 Arabidopsis thaliana genes and their homologs (Table 3). FIG. 11A-C is presented as an enlargement of FIG. 10. Phylogenetic analysis and phylogenetic tree construction were performed using Megalign ClustalW alignments exported in the MSF format. This MSF format was imported into JalView (www.jalview.org Clamp, M., Cuff, J., Searle, S. M. and Barton, G. J. (2004), "The Jalview Java Alignment Editor", Bioinformatics, 20, 426-7). Trees were built using one of the four available methods in JalView, and the alignments were sorted based on the resulting tree. Trees and alignments were evaluated for quality and accuracy. The tree in FIG. 10 was calculated with Average Distance Measure using the BLOSUM62 matrix.

Example 6

Soybean Expression Vectors for Co-Expression of Sucrose Transporter and DGAT Genes In addition to the genes, promoters, terminators and gene cassettes described herein, one skilled in the art can appreciate that other promoter/gene/terminator cassette combinations can be synthesized in a way similar to, but not limited to, that described herein for the co-expression of sucrose transporter and DGAT genes. Similarly, it may be desirable to co-express sucrose transporters of the present invention or other sucrose transporter genes with DGAT genes of the present invention or other DGAT genes.

Sucrose transporters such as those listed, but not liked to, Table 3 can be co-expressed with DGAT genes using techniques described herein. DGAT genes (such as those listed in, but not limited to, Table 5) can be used. NotI restriction enzyme sites flanking Sut and DGAT genes are added, Sut and DGAT genes are cloned into soybean expression vectors behind suitable promoters and Sut and DGAT genes are co-expressed using methods described herein.

TABLE 4

SUT Genes

| Gene | Organism | DNA SEQ ID NO: |
|---|---|---|
| AtSut4 | *Arabidopsis thaliana* | 5 |
| Glyma02g38300 | *Glycine max* | 37 |
| Glyma04g09460 | *Glycine max* | 39 |
| AtSut2 | *Arabidopsis thaliana* | 3 |
| Glyma08g40980 | *Glycine max* | 33 |
| Glyma18g15950 | *Glycine max* | 35 |
| AtSuc2 | *Arabidopsis thaliana* | 1 |

TABLE 5

DGAT genes

| Gene | Organism | Reference |
|---|---|---|
| YLDGAT1 | *Yarrowia lipolytica* | U.S. patent application Ser. No. 12/126,161 |
| YLDGAT2 | *Yarrowia lipolytica* | U.S. Pat. No. 7,267,976 & US Patent Application Publication No. 20080295204 |
| YLDGAT2_Y326F | *Yarrowia lipolytica* | U.S. patent application Ser. No. 12/126,1161 |
| YLDGAT2_Y326L | *Yarrowia lipolytica* | U.S. patent application Ser. No. 12/126,161 |
| YLDGAT2_Y326L | *Yarrowia lipolytica* | U.S. patent application Ser. No. 12/126,161 |
| TD_DGAT2A | *Torulospora delbrueckii* | U.S. patent application Ser. No. 12/470,517 |
| TD_DGAT2Acod | *Torulospora delbrueckii* | U.S. patent application Ser. No. 12/470,517 |
| TD_DGAT2B | *Torulospora delbrueckii* | U.S. patent application Ser. No. 12/470,517 |
| TD_DGAT2Bcod | *Torulospora delbrueckii* | U.S. patent application Ser. No. 12/470,517 |
| PA_DGAT2 | *Pichia anomala* | U.S. patent application Ser. No. 12/470,517 |
| PA_DGAT2cod | *Pichia anomala* | U.S. patent application Ser. No. 12/470,517 |
| DH_DGAT2 | *Debaryomyces hansenii* | U.S. patent application Ser. No. 12/470,517 |
| DH_DGAT2cod | *Debaryomyces hansenii* | U.S. patent application Ser. No. 12/470,517 |
| CZ_DGAT2 | *Candida zeylanoides* | U.S. patent application Ser. No. 12/470,517 |
| CZ_DGAT2cod | *Candida zeylanoides* | U.S. patent application Ser. No. 12/470,517 |
| LS_DGAT2 | *Lipomyces starkeyi* | U.S. patent application Ser. No. 12/470,517 |
| LS_DGAT2cod | *Lipomyces starkeyi* | U.S. patent application Ser. No. 12/470,517 |
| MC_DGAT2 | *Mucor circinelloides* | U.S. patent application Ser. No. 12/470,517 |
| MC_DGAT2cod | *Mucor circinelloides* | U.S. patent application Ser. No. 12/470,517 |
| PR_DGAT2 | *Phaffia rhodozyma* | U.S. patent application Ser. No. 12/470,517 |
| PR_DGAT2cod | *Phaffia rhodozyma* | U.S. patent application Ser. No. 12/470,517 |
| RG_DGAT2 | *Rhodotorula glutinis* | U.S. patent application Ser. No. 12/470,517 |
| RG_DGAT2cod | *Rhodotorula glutinis* | U.S. patent application Ser. No. 12/470,517 |
| MA_DGAT2 | *Mortierella alpina* | U.S. Pat. No. 7,198,937 and U.S. patent application Ser. No. 12/470,517 |
| MA_DGAT2cod | *Mortierella alpina* | U.S. patent application Ser. No. 12/470,517 |
| CC_DGAT2 | *Cryptococcus curvatus* | U.S. patent application Ser. No. 12/470,517 |
| CC_DGAT2cod | *Cryptococcus curvatus* | U.S. patent application Ser. No. 12/470,517 |
| LS_DGAT1 | *Lipomyces starkeyi* | U.S. patent application Ser. No. 12/470,517 |
| LS_DGAT1cod | *Lipomyces starkeyi* | U.S. patent application Ser. No. 12/470,517 |
| MA_DGAT1 | *Mortierella alpina* | U.S. Pat. No. 7,273,746 & U.S. patent application Ser. No. 12/470,517 |
| MA_DGAT1cod | *Mortierella alpina* | U.S. patent application Ser. No. 12/470,517 |
| GM-DGAT1 | *Glycine max* | U.S. Pat. No. 7,524,945 & U.S. patent application Ser. No. 12/470,569 |
| GM-DGAT1-C9 | *Glycine max* | U.S. patent application Ser. No. 12/470,569 |
| GM-DGAT1-C10 | *Glycine max* | U.S. patent application Ser. No. 12/470,569 |
| GM-DGATI-C11 | *Glycine max* | U.S. patent application Ser. No. 12/470,569 |
| GM-DGAT1-C9C10C11 | *Glycine max* | U.S. patent application Ser. No. 12/470,569 |

*each of the applications appearing in Table 5 is herein incorporated by reference in their entirety.

Example 7

Expression of *Arabidopsis thaliana* Sucrose Transporter Genes in Soybean Somatic Embryos It has been shown that YLDGAT1 (US Patent Application No. 2008/0295204 A) can increase oil and oleic acid compared to null transgenic soybean seeds when it is expressed either in soybean somatic embryos or in soybean seeds. The enhanced carbon flux into soybean embryos was tested. Over-expressed sucrose transporters led to further increase in oil content when co-expressed with YLDGAT1. Promoters that were used in plasmid construction for soybean embryo preferred over-expression of *Arabidopsis thaliana* sucrose transporter genes and the YLDGAT1 gene include, but are not limited to, *Glycine max* annexin and *Glycine max* glycinin Gy1. Transcription terminators that were used in plasmid construction for soybean embryo preferred overexpression of *Arabidopsis thaliana* sucrose transporter genes and the YLDGAT1 gene include, but are not limited to, bean phaseolin 3' and Glycine max Myb2 3'.

Constructs containing either vector only (pKR268, SEQ ID NO: 130) or YLDGAT1 gene served as controls. These were compared to co-expression constructs that harbor different sucrose transporters along with YLDGAT1 gene. These constructs were made as follows.

Construction of RTW218 (YLDGAT1)

Plasmid RTW218 (YLDGAT1) was constructed as follows. YLDGAT1 gene (SEQ ID NO: 127) was previously described in Publication No. 2008-0295204 A1 and the contents of which are hereby incorporated by reference. An expression cassette which harbors the YLDGAT1 gene fused to glycinin Gy1 promoter and the phaseolin terminator sequences, was excised as a 3.5 kb BamHI/SalI fragment from KS349 (SEQ ID NO: 129) which was previously described in Publication No Publication No. 2008-0295204 A1 (the contents of which are hereby incorporated by reference). This DNA fragment was ligated to BamHI/SalI linearized, dephosphorylated pKR268 vector DNA which contains an antibiotic marker cassette composed of 35S promoter, hygromycin gene, and NOS terminator. The resultant plasmid was set forth as RTW218 (YLDGAT1) (SEQ ID NO: 128).

Construction of RTW220 (ATSUC2HIS6 DGAT1 35Hyg)

The plasmid, RTW220 (ATSUC2HIS6 DGAT1 35Hyg) was constructed in many steps from several intermediate vectors. A vector, RTW147 (ANN-myb2 term sbf) (SEQ ID NO: 132), was used to prepare a cassette containing annexin promoter (Kinney and Liu, U.S. Pat. No. 7,129,089) and myb2 terminator (U.S. application Ser. No. 12/486,793). RTW155 (ATSUC2HIS6) described in Example 1 was digested with NotI and a fragment containing ATSUC2HIS6 gene was get-isolated. The fragment was then ligated into NotI digested, dephosphorylated RTW147 (ANN-myb2 term sbf) to give RTW158p1 (ann suc2) (SEQ ID NO: 133). Expression cassette containing annexin promoter, ATSUC2HIS6 gene, and myb2 terminator was isolated from RTW158p1 (ann suc2) by SbfI digestion. This DNA was ligated into ShfI linearized, dephosphorylated RTW218 (YLDGAT1) plasmid. The resultant plasmid was set forth as RTW220 (ATSUC2HIS6 DGAT1 35Hyg) (SEQ ID NO: 131).

Construction of RTW221 (ATSUT4HIS6 DGAT1 35 Hyg)

The plasmid, RTW221 (ATSUT4HIS6 DGAT1 35Hyg) was constructed similarly as for RTW220 (ATSUC1HIS6 DGAT1 35Hyg). RTW156 (AT SUT4 HIS6) described in Example 1 was digested with NotI and a fragment containing ATSUT4HIS6 was gel-isolated. The fragment was then ligated into NotI digested, dephosphorylated RTW147 (ANN-myb2 term sbf) to give RTW162p1 (ann sut4) (SEQ ID NO: 135). Expression cassette containing annexin promoter, ATSUT4HIS6 gene, and myb2 terminator was isolated from RTW162p1 (ann sut4) by SbfI digestion. This DNA was ligated into SbfI linearized, dephosphorylated RTW218 (YLDGAT1) plasmid. The resultant plasmid was set force as RTW221 (ATSUT4HIS6 DGAT1 35Hyg) (SEQ ID NO: 134).

Construction of RTW222 (ATSUT2HIS6 DGAT1 35Hyg)

The plasmid, RTW222 (ATSUT2HIS6 DGAT1 35Hyg) was constructed similarly as for RTW220 (ATSUC1HIS6 DGAT1 35Hyg). RTW157 (AT SUT2 HIS6) described in Example 1 was digested with NotI and a fragment containing ATSUT2HIS6 was gel-isolated. The fragment was then ligated into NotI digested, dephosphorylated RTW 147 (ANN-myb2 term sbf) to give RTW166p1 (ann sut2) (SEQ ID NO: 137). Expression cassette containing annexin promoter, ATSUT4HIS6 gene, and myb2 terminator was isolated from RTW166p1 (ann sut2) by SbfI digestion. This DNA was ligated into SbfI linearized, dephosphorylated RTW218 (YLDGAT1) plasmid. The resultant plasmid was set forth as RTW222 (ATSUT2HIS6 DGAT1 35Hyg) (SEQ ID NO: 136).

Transformation and Regeneration of Soybean (*Glycine max*)

Transgenic soybean lines are generated by the method of particle gun bombardment (Klein et al., *Nature* (London) 327:70-73 (1987); U.S. Pat. No. 4,945,050) using a BIO-RAD Biolistic PDS1000/He instrument and either plasmid or fragment DNA. The following stock solutions and media are used for transformation and regeneration of soybean plants:

Stock Solutions:
Sulfate 100× Stock:
  37.0 g $MgSO_4.7H_2O$, 1.69 g $MnSO_4.H_2O$, 0.86 g $ZnSO_4.7H_2O$, 0.0025 g $CuSO_4.5H_2O$
Halides 100× Stock:
  30.0 g $CaCl_2.2H_2O$, 0.083 g KI, 0.0025 g $CoCl_2.6H_2O$
P, B, Mo 100× Stock:
  18.5 g $KH2PO_4$, 0.62 g $H_3BO_3$, 0.025 g $Na_2MoO_4.2H_2O$
Fe EDTA 100× Stock:
  3.724 g $Na_2EDTA$, 2.784 g $FeSO_4.7H_2O$
2,4-D Stock:
  10 mg/mL Vitamin
B5 vitamins, 1000× Stock:
  100.0 g myo-inositol, 1.0 g nicotinic acid, 1.0 g pyridoxine HCl, 10 g thiamine.HCL.

Media (Per Liter):
SB199 Solid Medium:
  1 package MS salts (Gibco/BRL—Cat. No. 11117-066), 1 mL B5 vitamins 1000× stock, 30 g Sucrose, 4 ml 2, 4-D (40 mg/L final concentration), pH 7.0, 2 gm Gelrite
SB1 Solid Medium:
  1 package MS salts (Gibco/BRL—Cat. No. 11117-066), 1 mL B5 vitamins 1000× stock, 31.5 g Glucose, 2 mL 2, 4-D (20 mg/L final concentration), pH 5.7, 8 g TC agar
SB196:
  10 mL of each of the above stock solutions 1-4, 1 mL B5 Vitamin stock, 0.463 g (NH4)2 SO4, 2.83 g KNO3, 1 mL 2, 4D stock, 1 g asparagine, 10 g Sucrose, pH 5.7
SB71-4:
  Gamborg's B5 salts, 20 g sucrose, 5 g TC agar, pH 5.7.
SB103:
  1 pk. Murashige & Skoog salts mixture, 1 mL B5 Vitamin stock, 750 mg MgCl2 hexahydrate, 60 g maltose, 2 g gelrite, pH 5.7.
SB166:
  SB103 supplemented with 5 g per liter activated charcoal.

Soybean Embryogenic Suspension Culture Initiation:

Soybean cultures are initiated twice each month with 5-7 days between each initiation. Pods with immature seeds from available soybean plants 45-55 days after planting are picked, removed from their shells and placed into a sterilized magenta box. The soybean seeds are sterilized by shaking them for 15 min in a 5% Clorox solution with 1 drop of ivory soap (i.e., 95 mL of autoclaved distilled water plus 5 mL Clorox and 1 drop of soap, mixed well). Seeds are rinsed using 2 1-liter bottles of sterile distilled water and those less than 3 mm are placed on individual microscope slides. The small end of the seed is cut and the cotyledons pressed out of the seed coat. Cotyledons are transferred to plates containing SB199 medium (25-30 cotyledons per plate) for 2 weeks, then transferred to SB1 for 2-4 weeks. Plates are wrapped with fiber tape. After this time, secondary embryos are out and placed into SB196 liquid media for 7 days.

Culture Conditions:

Soybean embryogenic suspension cultures (cv. Jack) are maintained in 50 mL liquid medium SB196 on a rotary shaker, 150 rpm, 26° C. with cool white fluorescent lights on 16:8 h day/night photoperiod at light intensity of 60-85 µE/m2/s. Cultures are subcultured every 7 days to two weeks by inoculating approximately 35 mg of tissue into 50 mL of fresh liquid SB196 (the preferred subculture interval is every 7 days).

Preparation of DNA for Bombardment:

In particle gun bombardment procedures it is possible to use purified 1) entire plasmid DNA; or 2) DNA fragments containing only the recombinant DNA expression cassette(s) of interest. For every seventeen bombardment transformations, 85 µL of suspension is prepared containing 1 to 90 picograms (pg) of plasmid DNA per base pair of each DNA plasmid. Both recombinant DNA plasmids are co-precipitated onto gold particles as follows. The DNAs in suspension are added to 50 µL of a 10-60 mg/mL 0.6 µm gold particle suspension and then combined with 50 µL $CaCl_2$ (2.5 M) and 20 µL spermidine (0.1 M). The mixture is vortexed for 5 sec, spun in a microfuge for 5 sec, and the supernatant removed. The DNA-coated particles are then washed once with 150 µL of 100% ethanol, vortexed and spun in a microfuge again, then resuspended in 85 µL of anhydrous ethanol. Five µL of the DNA-coated gold particles are then loaded on each macrocarrier disk.

Tissue Preparation and Bombardment with DNA:

Approximately 150 to 250 mg of two-week-old suspension culture is placed in an empty 60 mm×15 mm petri plate and the residual liquid removed from the tissue using a pipette. The tissue is placed about 3.5 inches away from the retaining screen and each plate of tissue is bombarded once. Membrane rupture pressure is set at 650 psi and the chamber is evacuated to −28 inches of Hg. Following bombardment, the tissue from each plate is divided between two flasks, placed back into liquid media, and cultured as described above.

Selection of Transformed Embryos and Plant Regeneration:

After bombardment, tissue from each bombarded plate is divided and placed into two flasks of SB196 liquid culture maintenance medium per plate of bombarded tissue. Seven days post bombardment, the liquid medium in each flask is replaced with fresh SB196 culture maintenance medium supplemented with 100 ng/mL selective agent selection medium). For selection of transformed soybean cells the selective agent used can be a sulfonylurea (SU) compound with the chemical name, 2-chloro-N-((4-methoxy-6 methy-1,3,5-triazine-2-yl)aminocarbonyl)benzenesulfonamide (common names: DPX-W4189 and chlorsulfuron). Chlorsulfuron is the active ingredient in the DuPont sulfonyturea herbicide, GLEAN®. The selection medium containing SU is replaced every two weeks for 6-8 weeks. After the 6-8 week selection period, islands of green, transformed tissue are observed growing from untransformed, necrotic embryogenic clusters. These putative transgenic events are isolated and kept in SB196 liquid medium with SU at 100 ng/mL for another 2-6 weeks with media changes every 1-2 weeks to generate new, clonally propagated, transformed embryogenic suspension cultures. Embryos spend a total of around 8-12 weeks in contact with SU. Suspension cultures are subcultured and maintained as clusters of immature embryos and also regenerated into whole plants by maturation and germination of individual somatic embryos.

Somatic embryos became suitable for germination after four weeks on maturation medium (1 week on SB166 followed by 3 weeks on SB103). They are then removed from the maturation medium and dried in empty petri dishes for up to seven days. The dried embryos are then planted in SB71-4 medium where they are allowed to germinate under the same light and temperature conditions as described above. Germinated embryos are transferred to potting medium and grown to maturity for seed production.

Oil Analysis:

For oil analysis of somatic embryos, embryos were harvested after two-three weeks of culture in the liquid maturation medium SB228 (SHaM). Approximately 30 events were created in transformations with pKR268, RTW218, RTW220, RTW221 and RTW222. All embryos generated for a given event were harvested in bulk and processed as follows. Embryos were frozen on dry ice or by incubation in a −80° C. freezer for two h followed by lyophilization for 48 h.

Dried embryos were ground to a fine powder using a genogrinder vial (½"×2" polycarbonate) and a steel ball (SPEX Centriprep (Metuchen, N.J., U.S.A.). Grinding time was 30 sec at 1450 oscillations per min. Ground embryo tissues were analyzed for their oil content by NMR method which was described as in US patent application 2008/0295204 A.

Embryo oil content was calculated as follows:

$$\% \text{ oil (\% wt basis)} = \frac{(NMR \text{ signal/sample wt }(g)) - 70.58}{351.45} \times 1.212056$$

For fatty acid composition analysis, aliquots of 30 to 50 mg of fine powdered somatic embryo tissues were weighed (to 0.0001 g precision) into 13×100 mm glass tubes fitted with Teflon® lined screw caps. Heptane (2 mL) was added to the powders in the tubes and after vortex mixing they were placed into an ultrasonic bath (VWR Scientific Model 750D) filled with water heated to 60° C. The samples were sonicated at full-power (~360 W) for 15 min and were then centrifuged (5 min×1700 g). The supernatants were transferred to clean 13×100 mm glass tubes and the pellets were extracted 2 more times with heptane (2 mL, second extraction, 1 mL third extraction). The supernatants from the three extractions were combined. Five hundred micro liters of the pooled extracts were transferred to clean 13×100 mm glass tubes. Internal standard [10 µL; 10 mg triheptadecanoin (Nu-Chek Prep, Elysian, Minn., USA)/mL toluene] was added to each tube followed by 1 mL 1% sodium methoxide (v/v in anhydrous methanol). The tubes were capped with Teflon® lined closures and after thorough vortex mixing the samples were heated at 50° C. for 30 min. After cooling to room temperature 1 mL 25% (wt/v) sodium chloride and 1 mL of heptane were added to each sample. The tubes were vortex mixed and after centrifugation (3 min at 1700×g) a portion of the upper organic phase was transferred to a sample vial for GC analysis. Analysis was performed on an Agilent 6890 gas chromatograph fitted with an Omegawax 320 capillary column (30 m, 0.32 mm OD, 0.25 µm film thickness; Supelco, Bellefonte Pa., USA). Detection was by Flame Ionization. Relative peak areas were used to calculate the fatty acid profiles and quantitation was performed relative to the internal standard. Results of these experiments are summarized in FIG. 12 and Table 6.

TABLE 6

Oil increase by sucrose transporters co-expressed with YLDGAT1 (5 events each from lowest-oil-accumulating events and highest-oil-accumulating events or % 18:1 events were averaged and the difference was calculated). % 18:1 levels were calculated in a similar manner.

| | Avg Low % Oil | Avg High % Oil | Difference in % Oil | Avg Low % 18:1 | Avg High % 18:1 | Difference in % 18:1 |
|---|---|---|---|---|---|---|
| pKR268 (vector only) | 4.4 | 9.6 | 5.2 | 16.59 | 21.89 | 5.30 |
| RTW218 (YLDGAT 1) | 6.3 | 13.5 | 7.2 | 24.82 | 36.38 | 11.56 |
| RTW220 (YLDGAT1 and ATSUC2) | 7.1 | 13.7 | 6.6 | 20.58 | 34.43 | 13.84 |
| RTW221 (YLDGAT1 and ATSUT4) | 5.5 | 15.4 | 9.9 | 17.71 | 34.53 | 16.82 |
| RTW222 (YLDGAT1 and ATSUT2) | 7.5 | 15.6 | 8.1 | 20.5 | 36.57 | 16.07 |

In summary, as disclosed previously, YLDGAT1 gene expression consistently increased total oil level as well as oleic acid content in soybean somatic embryos when compared to the control transgenic lines which carried only the native vector construct. Co-expression of high affinity, SUT1-type transporter, ATSUC2 and YLDGAT1 gene yielded similar levels of oil and oleic acid to events expressing the YLDGAT1 gene alone. However, co-expression of low to medium affinity SUT2 and SUT4-type transporters, ATSUT2 and ATSUT4 showed significant additive effect by further increasing oil and oleic levels compared to transgenic embryos with only YLDGAT1 gene. Taken together these findings strongly suggest that co-expression of high capacity sucrose transporters including ATSUT2 and ATSUT4 with VLDGAT genes provides an efficient strategy to achieve an increase in the total oil content of soybean seed.

Example 8

Co-Expression of *Yarrowia lipolytica* DGAT Genes and Affinity, High Capacity Sucrose Transporter Genes in Soybean Seed A DNA construct for co-expression of YLDGAT1 and a hexa-histidine tagged version of *Arabidopsis* SUT4 (At1g09960) was generated as follows: A plasmid, RTW212 (SEQ ID NO: 138), containing a soybean selection marker cassette which was composed of soybean SAMS promoter, soybean HRA gene, and soybean ALS terminator, was used to construct RTW227 vector. ATSUT4 expression cassette was derived from RTW162p1 (ann sut4) (SEQ ID NO: 135) described in Example 7, RTW162p1 (ann sut4) was digested with SbfI and a fragment containing soybean annexin promoter, ATSUT4 gene, and soybean myb2 terminator, was gel-purified. The fragment was ligated to SbfI linearized, dephosphorylated RTW212 plasmid to give RTW226 (SEQ ID NO: 139). RTW218, which was described in Example 7, was a source for YL-DGAT1 expression cassette containing soybean GY1 promoter, YL-DGAT1 gene, and phaseolin terminator. RTW218 was digested with BsiWI and SalI. SalI site was completely filled using Klenow polymerase reaction. A fragment containing YL-DGAT1 expression cassette was then gel-purified and ligated into SmaI/BsiWI digested, dephosphorylated RTW226. The resultant plasmid was set forth as RTW227F (ATSUT4 DGAT1 ALS), PHP36710 (SEQ ID NO: 140).

Soybeans were transformed as shown in Example 7.

Somatic embryos became suitable for germination after four weeks and were then removed from the maturation medium and dried in empty petri dishes for one to five days. The dried embryos were then planted in SB71-4 medium where they were allowed to germinate under the same light and temperature conditions as described above. Germinated embryos were transferred to sterile soil and grown to maturity for seed production.

A total of 69 $T_0$ plants derived from 42 transgenic events were generated with a 10.5 kb AscI restriction fragment of PHP36710 at concentration of 15 pg per bp of plasmid DNA per gold particle preparation (see above). For every $T_0$ plant 8 seed were initially screened for the absence or presence of the transgene-derived YLDGAT by assaying the seed fatty acid composition. Seed oil content was measured by NMR as described in US patent application 2008/0295204 A. US patent application 2008/0295204 A1 also discloses that expression of *Yarrowia* DGAT genes in transgenic soybean somatic embryos and soybean seed was associated with increased incorporation of oleic acid into the total esterified fatty acid fraction which on the other hand was tightly correlated with total accumulation of fatty acids is this tissue. In T1 seed derived from 27 of the total 42 events generated with PHP36710 the $R^2$ value expressing correlation between oleic acid and total fatty acid content was >0.2. In these events the $R^2$ related to the correlation between oleic acid content and total fatty acid content ranged from 0.21 to 0.98. T1 seed from four events were analyzed in more detail. Results are shown in Table 7 where n is the number of seeds analyzed, avg % oil<18% oleic is the average oil content of seed weight) of all seeds with an oleic acid content of less than 18% of the total fatty acid content, avg % oil≥18% oleic is the average oil content (% of seed weight) of all seeds with an oleic acid content that is equal to or greater than 18% of the total fatty acid content, delta % points is the difference in oil content (% points) between seeds with an oleic acid content that is equal to or greater than 18% of the total fatty acid content and seeds with an oleic acid content of less than 18% of the total fatty acid content, delta % is the difference in oil content (%) of seed with an oleic acid content that is equal to or greater than 18% of the total fatty acid content and seeds with an oleic acid content of less than 18% of the total fatty acid content, and R2% oleic/% oil is the correlation coefficient for the relationship between oleic acid content (% of total fatty acids) and oil content (% of seed) for T1 seed of a given transgenic event.

TABLE 7

Oil Content of T1 Soybean Seed Generated with PHP 36710

| | n | avg % oil <18% oleic | n | avg % oil ≥18% oleic | delta % points | delta % | R² % oleic/ % oil |
|---|---|---|---|---|---|---|---|
| AFS 5925.1.9.2 | 5 | 17.2 | 19 | 22.1 | 4.9 | 28.6 | 0.71 |
| AFS 5925.2.7.1 | 1 | 18.6 | 17 | 23.4 | 4.8 | 25.5 | 0.28 |
| AFS 5925.1.6.1 | 5 | 19.1 | 19 | 22.0 | 2.9 | 15.1 | 0.57 |
| AFS 5925.1.6.1 | 7 | 20.6 | 17 | 23.1 | 2.5 | 12.2 | 0.61 |

In summary applicants have demonstrated that co-expression of DGAT genes and SUT2 or SUT4 sucrose transporter genes provides an efficient method to increase the total fatty acid content of seed.

Example 9

Cloning Soybean Sucrose Transporter Genes for Co-Expression with DGAT Genes in Soy The present example describes cloning of soy Sut2 and Sut4 homologs for co-expression with DGAT genes.

One skilled in the art will appreciate that a number of molecular biology techniques exist for cloning soy genes from cDNA or cDNA libraries. Most techniques involve isolating total RNA from soy tissue followed by either direct synthesis of cDNA from total RNA or purification of mRNA first followed by cDNA synthesis. For example, total RNA can be isolated from soy tissue using TRIzol® Reagent (Invitrogen Corporation, Carlsbad, Calif.) and following the manufacturer's protocol provided. mRNA can be isolated from total RNA using the mRNA Purification Kit (Amersham Biosciences, Piscataway, N.J.) following the manufacturer's protocol provided, A cDNA library can be generated from total RNA or mRNA using the Cloneminer™ cDNA Library Construction Kit (Cat. No. 18249-029, Invitrogen Corporation, Carlsbad, Calif.) and following the manufacturer's protocol provided (Version B, 25-0608). cDNA libraries may also be prepared using Uni-ZAP™ XR vectors according to the manufacturer's protocol (Stratagene Cloning Systems, La Jolla, Calif.). The Uni-ZAP™ XR libraries are converted into plasmid libraries according to the protocol provided by Stratagene. Upon conversion, cDNA inserts are contained in the plasmid vector pBluescript. In addition, the cDNAs may be introduced directly into precut Bluescript II SK(+) vectors (Stratagene) using T4 DNA ligase (New England Biolabs), followed by transfection into DH10B cells according to the manufacturer's protocol (GIBCO BRL Products). Normalized cDNA libraries can also be prepared, for example as described in U.S. Pat. No. 5,482,845, incorporated herein by reference.

Glyma08g40980 (SEQ ID NO: 33) is amplified from soy cDNA or a soy cDNA library using oligonucleotides GmSut2-1For (SEQ ID NO: 141) and GmSut2-1 Rev (SEQ ID NO: 142), designed to introduce NotI site flanking the gene, along with a suitable DNA polymersase such as GoTaq polymerase (Promega, USA) or Phusion polymerase (New England Biolabs, Inc., Ipswich, Mass.) and following the manufacturer's protocol. The resulting PCR product is cloned into a suitable cloning vector such as the pCR-Blunt® cloning vector using the Zero Blunt® PCR Cloning Kit Invitrogen Corporation), following the manufacturer's protocol when Phusion polymerase is used or into pGEM®-T Easy Vector (Promega), following the manufacturer's protocol, when GoTaq polymerase is used.

In a similar way Glyma18g15950 (SEQ ID NO: 35) is amplified with oligonucleotides GmSut2-2For (SEQ ID NO: 143) and GmSut2-2Rev (SEQ ID NO: 144), Glyma02g38300 (SEQ ID NO: 37) is amplified with oligonucleotides SA150 (SEQ ID NO: 145) and SA151 (SEQ ID NO: 146) and Glyma04g09460 (SEQ ID NO: 39) is amplified with oligonucleotides SA148 (SEQ ID NO: 147) and SA149 (SEQ ID NO: 148).

Alternatively, soy Sut genes flanked by NotI restriction sites can be synthesized directly by companies such as, but not limited to, DNA 2.0 (California, USA), Codon Devices (MA, USA) or by GENEART AG (Regensburg, Germany).

In this way, soy Sut homolog genes flanked by NotI sites can be easily cloned into suitable soy expression vectors.

For example, NotI fragment of a soy Sut homolog gene can be ligated into a vector, which has an expression cassette composed of annexin promoter and soybean myb2 terminator. Such vector can be RTW162p1 as described in Example 7. Then the cassette can be transferred to any plasmids that can be used either for soybean somatic embryonic transformation or soybean stable transformation.

Example 10

Co-Expression of Sucrose Transporters and *Yarrowia lipolytica* DGAT Genes in Maize Co-expression of sucrose transporters such as those listed in but not limited to, Table 4 or SUT2, or SUT4 homologs in Table 3 with DGAT genes can be used in the seeds of maize to increase the oil content of this tissue. As described below, this result can be achieved by transforming maize with expression cassettes comprising an open reading frame of DGAT genes operably linked on their 5' ends to embryo preferred promoters, such as the promoter for the maize 16 kDa oleosin gene (Lee, K. and Huang, A. H., *Plant Mol. Biol.* 26:1981-1987 (1984)) and maize embryo abundant (EAP1) promoter and terminator (US 2006272058 A1), and similarly configured sucrose transporter genes.

For example, an expression cassette comprising the promoter from the maize 16 kDa oleosin gene (OLE PRO), the coding sequence of the YLDGAT gene and the polyadenylation signal sequence/terminator from the nopaline synthase (NOS) gene of *Agrobacterium tumefaciens* is constructed using methods and technologies known in the art. A second expression cassette comprises a sucrose transporter gene under the transcriptional control of the maize embryo abundant protein (EAP1) promoter and terminator, with the maize ADH1 INTRON1 inserted between the promoter and coding sequence for enhanced expression. The two expression cassettes are linked, together with a gene encoding a selectable marker, in a binary vector suitable for *Agrobacterium*-mediated transformation of maize.

An *Agrobacterium*-based protocol can be used for the transformation of maize (see below). The resulting binary vector is introduced into *Agrobacterium* LBA4404 (PHP10523) cells, preferably by electroporation. An in vivo recombination generates a cointegrate plasmid between the introduced binary vector and the vir plasmid (PHP10523) resident in the *Agrobacterium* cells. The resulting *Agrobacterium* cells are used to transform maize.

Transformation of Maize Mediated by *Agrobacterium:*

Freshly isolated immature embryos of maize, about ten days after pollination (DAP), can be incubated with the *Agrobacterium*. The preferred genotype for transformation is the highly transformable genotype Hi-II (Armstrong, *Maize Gen. Coop. Newsletter* 65:92-93 (1991)). An F1 hybrid created by crossing a Hi-II with an elite inbred may also be used. After *Agrobacterium* treatment of immature embryos, the embryos can be cultured on medium containing toxic levels of herbicide. Only those cells that receive the herbicide resistance gene, and the linked gene(s), grow on selective medium. Transgenic events so selected can be propagated and regenerated to whole plants, produce seed, and transmit transgenes to progeny.

Preparation of *Agrobacterium:*

The engineered *Agrobacterium tumefaciens* LBA4404 can be constructed to contain plasmids for seed-preferred expression of DGAT and sucrose transporter genes, as disclosed in U.S. Pat. No. 5,591,616 (the contents of which are hereby incorporated by reference). To use the engineered construct in plant transformation, a master plate of a single bacterial colony transformed with plasmids for seed-preferred expression of both genes can be prepared by inoculating the bacteria on minimal AB medium and allowing incubation at 28° C. for approximately three days. (The composition and preparation of minimal AB medium has been previously described in PCT Publication No. WO 02/009040 (the contents of which are hereby incorporated by reference). A working plate can then be prepared by streaking the transformed *Agrobacterium* on YP medium (0.5% (w/v) yeast extract, 1% (w/v) peptone, 0.5% (w/v) sodium chloride, 1.5% (w/v) agar) that contains 50 µg/mL of spectinomycin.

The transformed *Agrobacterium* for plant transfection and co-cultivation can then be prepared one day prior to maize transformation. Into 30 mL of minimal A medium (prepared as described in PCT Publication No. WO 02/009040) in a flask was placed 50 µg/mL spectinomycin, 100 µM acetosyringone, and about a ⅛ loopful of *Agrobacterium* from a one to two-day-old working plate. The *Agrobacterium* can then be grown at 28° C. with shaking at 200 rpm for approximately fourteen h. At mid-log phase, the *Agrobacterium* can be harvested and resuspended at a density of 3 to 5×108 CTU/mL in 561Q medium that contains 100 µM acetosyringone using standard microbial techniques. The composition and preparation of 561Q medium was described in PCT Publication No. WO 02/009040.

Immature Embryo Preparation:

Nine to ten days after controlled pollination of a maize plant, developing immature embryos are opaque and 1-1.5 mm long. This length is the optimal size for infection with the *Agrobacterium*. The husked ears can be sterilized in 50% commercial bleach and one drop Tween-20 for thirty minutes, and then rinsed twice with sterile water. The immature embryos can then be aseptically removed from the caryopsis and placed into 2 mL of sterile holding solution consisting of medium 561Q that contains 100 µM of acetosyringone, *Agrobacterium* Infection and Co-Cultivation of Embryos:

The holding solution can be decanted from the excised immature embryos and replaced with transformed *Agrobacterium*. Following gentle mixing and incubation for about five minutes, the *Agrobacterium* can be decanted from the immature embryos. Immature embryos were then moved to a plate of 562P medium, the composition of which has been previously described in PCT Publication No. WO 02/009040. The immature embryos can be placed on this media scutellum surface pointed upwards and then incubated at 20° C. for three days in darkness. This step can be followed by incubation at 28° C. for three days in darkness on medium 562P that contains 100 µg/mL carbenecillin as described in U.S. Pat. No. 5,981,840.

Selection of Transgenic Events:

Following incubation, the immature embryos can be transferred to 5630 medium, which can be prepared as described in PCT Publication No. WO 02/009040, This medium contains Bialaphos for selection of transgenic plant cells as conferred by the BAR gene that is linked to barley HGGT expression cassette. At ten to fourteen-day intervals, embryos were transferred to 5630 medium. Actively growing putative transgenic embryogenic tissue can be after six to eight weeks of incubation on the 5630 medium.

Regeneration of $T_0$ Plants:

Transgenic embryogenic tissue is transferred to 288W medium and incubated at 28° C. in darkness until somatic embryos matured, or about ten to eighteen days. Individual matured somatic embryos with well-defined scutellum and coleoptile are transferred to 272 embryo germination medium and incubated at 28° C. in the light. After shoots and roots emerge, individual plants are potted in soil and hardened-off using typical horticultural methods.

288W medium contains the following ingredients: 950 mL of deionized water; 4.3 g of MS Salts (Gibco); 0.1 g of myo-inositol; 5 mL of MS Vitamins Stock Solution (Gibco); 1 mL of zeatin (5 mg/mL solution); 60 g sucrose; 8 g of agar (Sigma A-7049, Purified), 2 mL of indole acetic acid (0.5 mg/mL solution*); 1 mL of 0.1 mM ABA*; 3 mL of Bialaphos (1 mg/mL solution*); and 2 mL of carbenicillin (50 mg/mL solution). The pH of this solution is adjusted to pH 5.6. The solution is autoclaved and ingredients marked with an asterisk (*) are added after the media has cooled to 60° C.

Medium 272 contains the following ingredients: 950 mL of deionized water; 4.3 g of MS salts (Gibco); 0.1 g of myo-inositol.; 5 mL of MS vitamins stock solution (Gibco); 40 g of Sucrose; and 1.5 g of Gelrite. This solution is adjusted to pH 5.6 and then autoclaved.

Example 11

Analysis of Kernel Oil Content

Nuclear Magnetic Resonance (NMR) Analysis

Seed are imbibed in distilled water for 12-24 hours at 4° C. The embryo is dissected away and stored in a 48 well plate. The samples are lyophilized over-night in a Virtis 24×48 lyophilizer. The NMR (Process Control Technologies—PCT (Ft. Collins, Colo.)) is set up as per the manufacturer's instructions. The NMR is calibrated using a series of 5 mm NMR tubes containing precisely measured amounts of corn oil (Mazola). The calibration standards are 3, 6, 9, 12, 15, 18, 21, 27, 33, and 40 mg of oil.

Example 12

Introduction of SUT2 and SUT4 Sucrose Transporters into a High Oil Plant

SUT2 or SUT4 sucrose transporters can be introduced into a high oil plant by crossing a first plant with a naturally occurring high oil phenotype explained in Example 1 to a second plant with altered expression of SUT2 or SUT 4 explained in Example 1. The progeny resulting from the cross can be evaluated for a further increase in oil production and overexpression of SUT2 or SUT 4 sucrose transporters can be compared to said first plant.

Furthermore, sucrose transporters can be introduced into a high oil plant cell by introduction of a recombinant DNA construct comprising polynucleotide operably linked to at least one regulatory element, wherein said polynucleotide encodes a polypeptide that is a SUT2 or SUT 4 sucrose transporter. A transgenic plant can be regenerated from the regenerable plant cell wherein the transgenic plant comprises in its genome the recombinant DNA construct. A progeny plant can be derived from the transgenic plant and can be selected for expression of SUT2 or SUT 4 sucrose transporters.

Example 13

Co-Expression of Sucrose Transporters and *Yarrowia lipolytica* DGAT Genes in Oilseed Plants Overexpression of exogenous or endogenous sucrose transporter genes in combination with *Yarrowia lipolytica* DGAT genes can be performed in any oilseed plant.

Example 14

Co-Expression of Sucrose Transporters and *Yarrowia lipolytica* DGAT1 in Soy The present example describes cloning soy Sut4 and Sut2 genes into soy expression vectors and co-expressing with the *Yarrowia lipolytica* DGAT1 gene (YLDGAT1) in soy somatic embryos. In all cases, each Sut gene is under control of the soy annexin promoter and YLDGAT1 is under control of the soy glycinin Gy1 promoter as described for expression vectors in Example 7.

Construction of pKR1684 (GmSut4-1 YLDGAT1 35Hyg)

Glyma02g38300 (SEQ ID NO:37), also called GmSut4-1, was PCR amplified from a soy cDNA library using oligonucleotides SA150 (SEQ ID NO: 145) and SA151 (SEQ ID NO: 146) and GoTaq polymerase as described in Example 9. The resulting DNA fragment was cloned into pGEM®-T Easy Vector (Promega), following the manufacturer's protocol, to produce Glyma02g38300 in pGEM-T Easy (SEQ ID NO: 151).

The NotI fragment of Glyma02g38300 in pGEM-T Easy (SEQ ID NO: 151), containing GmSut4-1, was cloned into the NotI site of RTW147 (SEQ ID NO: 132) to produce pKR1680 (SEQ ID NO: 152).

The PstI fragment of pKR1680 (SEQ ID NO: 152), containing GmSut4-1, was cloned into the SbfI site of RTW218 (SEQ ID NO: 128) to produce pKR1684 (SEQ ID NO: 153).

Construction of pKR 1685 (GmSut2-1 YLDGAT1 35:Hyg)

Glyma08g40980 (SEQ ID NO: 33), also called GmSut2-1, was PCR amplified from a soy cDNA library using oligonucleotides GmSut2-1For (SEQ ID NO: 141) and GmSut2-1Rev (SEQ ID NO: 142) and Phusion polymerase as described in Example 9. The resulting DNA fragment was cloned into Zero Blunt® PCR Cloning Kit (Invitrogen Corporation), following the manufacturer's protocol, to produce pLF235 (SEQ ID NO: 154).

The NotI fragment of pLF235 (SEQ ID NO: 154), containing GmSut2-1, was cloned into the NotI site of RTW147 (SEQ ID NO: 132) to produce pKR1681 (SEQ ID NO: 155).

The PstI fragment of pKR1681 (SEQ ID NO: 155), containing GmSut2-1, was cloned into the SbfI site of RTW218 (SEQ ID NO: 128) to produce pKR1685 (SEQ ID NO: 156).

Construction of pKR1686 (GmSut4-2 YLDGAT1 35Hyg)

Glyma04g09460 (SEQ ID NO: 39), also called GmSut4-2, was PCR amplified from a soy cDNA library using oligonucleotides GmSut4-2For (SEQ ID NO: 157) and GmSut4-2Rev (SEQ ID NO: 158) and Phusion polymerase as described in Example 9. The resulting DNA fragment was cloned into Zero Blunt® PCR Cloning Kit (Invitrogen Corporation), following the manufacturer's protocol, to produce pLF236 (SEQ ID NO: 159).

The NotI fragment of pLF236 (SEQ ID NO: 159), containing GmSut4-2, was cloned into the NotI site of RTW 147 (SEQ ID NO: 132) to produce pKR1682 (SEQ ID NO: 160).

The SbfI fragment of pKR1682 (SEQ ID NO: 160), containing GmSut4-2, was cloned into the SbfI site of RTW218 (SEQ ID NO: 128) to produce pKR1686 (SEQ ID NO: 161).

Soybean embryonic suspension cultures (cv. Jack) were initiated and maintained as described in Example 7. Soybean embryonic suspension cultures were transformed with RTW218 (SEQ ID NO: 128, Example 7), pKR1684, pKR1685 or pKR1686, by particle gun bombardment as described in Example 7 with the following modifications.

Preparation of DNA for Bombardment:

A 50 µL aliquot of sterile distilled water containing 1 mg of gold particles was added to 5 µL of a 1 µg/µL DNA solution (either intact plasmid or DNA fragment prepared as described above), 50 µL 2.5M $CaCl_2$ and 20 µL of 0.1 M spermidine. The mixture was pulsed 5 times on level 4 of a vortex shaker and spun for 5 sec in a bench microfuge. After a wash with 150 µL of 100% ethanol, the pellet was suspended by sonication in 85 µL of 100% ethanol. Five µL of DNA suspension was dispensed to each flying disk of the Biolistic PDS1000/HE instrument disk. Each 5 µL aliquot contained approximately 0.058 mg gold particles per bombardment (i.e., per disk).

Tissue Preparation and Bombardment with DNA:

Approximately 100-150 mg of 7 day old embryonic suspension cultures were placed in an empty, sterile 60×15 mm petri dish and the dish was placed inside of an empty 150×25 mm Petri dish. Tissue was bombarded 1 shot per plate with membrane rupture pressure set at 650 PSI and the chamber was evacuated to a vacuum of 27-28 inches of mercury. Tissue was placed approximately 2.5 inches from the retaining/stopping screen.

Selection of Transformed Embryos:

Transformed embryos were selected using hygromycin as the selectable marker. Specifically, following bombardment, the tissue was placed into fresh SB196 media and cultured as described above. Six to eight days post-bombardment, the SB196 is exchanged with fresh SB196 containing 30 mg/L hygromycin. The selection media was refreshed weekly. Four to six weeks post-selection, green, transformed tissue was observed growing from untransformed, necrotic embryogenic clusters. Isolated, green tissue was removed and inoculated into multi-well plates to generate new, clonally propagated, transformed embryogenic suspension cultures.

Embryo Maturation:

Transformed embryogenic clusters were matured in soybean histodifferentiation and maturation liquid medium (SHaM liquid media; Schmidt et al., *Cell Biology and Morphogenesis* 24:393 (2005)), using a modified procedure. Briefly, after 4 weeks of selection in SB196, as described above, embryo clusters are removed to 35 mL of SB228 (SHaM liquid media) in a 250 mL Erlenmeyer flask. Tissue is maintained in SHaM liquid media on a rotary shaker at 130 rpm and 26° C., with cool white fluorescent lights on a 16:8 hr day/night photoperiod at a light intensity of 60-85 µE/m2/s for 2 weeks as embryos matured. Embryos grown for 2 weeks in SHaM liquid media are equivalent in size and fatty acid content to embryos cultured on SB166/SB103 for 5-8 weeks.

SHaM Media Recipes:

SB 228—Soybean Histodifferentiation & Maturation (SHaM) (Per Liter)

| | |
|---|---|
| DDI H2O | 600 mL |
| FN-Lite Macro Salts for SHaM 10x | 100 mL |
| MS Micro Salts 1000x | 1 mL |
| MS FeEDTA 100x | 10 mL |
| CaCl 100x | 6.82 mL |
| B5 Vitamins 1000x | 1 mL |
| L-Methionine | 0.149 g |
| Sucrose | 30 g |
| Sorbitol | 30 g |
| Adjust volume to 900 mL | |
| pH 5.8 | |
| Autoclave | |
| Add to cooled media (≤30° C.): | |
| *Glutamine (Final conc. 30 mM) 4% | 110 mL |

*Note:
Final volume will be 1010 mL after glutamine addition.

Because glutamine degrades relatively rapidly, it may be preferable to add immediately prior to using media. Expiration 2 weeks after glutamine is added; base media can be kept longer w/o glutamine.

FN-Lite Macro for SHAM 10×—Stock #1 (Per Liter)

| | |
|---|---|
| $(NH_4)_2SO_4$ (Ammonium Sulfate) | 4.63 g |
| $KNO_3$ (Potassium Nitrate) | 28.3 g |
| $MgSO_4*7H_2O$ (Magnesium Sulfate Heptahydrate) | 3.7 g |
| $KH_2PO_4$ (Potassium Phosphate, Monobasic) | 1.85 g |
| Bring to volume | |
| Autoclave | |

MS Micro 1000×—Stock #2 (Per 1 Liter)

| | |
|---|---|
| $H_3BO_3$ (Boric Acid) | 6.2 g |
| $MnSO_4*H_2O$ (Manganese Sulfate Monohydrate) | 16.9 g |
| $ZnSO4*7H20$ (Zinc Sulfate Heptahydrate) | 8.6 g |
| $Na_2MoO_4*2H20$ (Sodium Molybdate Dihydrate) | 0.25 g |
| $CuSO_4*5H_2O$ (Copper Sulfate Pentahydrate) | 0.025 g |
| $CoCl_2*6H_2O$ (Cobalt Chloride Hexahydrate) | 0.025 g |
| KI (Potassium Iodide) | 0.8300 g |
| Bring to volume | |
| Autoclave | |

FeEDTA 100×—Stock #3 (Per Liter)

| | |
|---|---|
| $Na_2EDTA*$ (Sodium EDTA) | 3.73 g |
| $FeSO_4*7H20$ (Iron Sulfate Heptahydrate) | 2.78 g |

*EDTA must be completely dissolved before adding iron.
Bring to Volume Solution is photosensitive. Bottle(s) should be wrapped in foil to omit light.
Autoclave

Ca 100×—Stock #4 (Per Liter)

| | |
|---|---|
| $CaCl_2*2H_2O$ (Calcium Chloride Dihydrate) | 44 g |
| Bring to Volume | |
| Autoclave | |

B5 Vitamin 1000×-Stock #5 (Per Liter)

| | |
|---|---|
| Thiamine*HCl | 10 g |
| Nicotinic Acid | 1 g |
| Pyridoxine*HCl | 1 g |
| Myo-Inositol | 100 g |
| Bring to Volume | |
| Store frozen | |

4% Glutamine—Stock #6 (Per Liter)

| | |
|---|---|
| DDI water heated to 30° C. | 900 mL |
| L-Glutamine | 40 g |
| Gradually add while stirring and applying low heat. | |
| Do not exceed 35° C. | |
| Bring to Volume | |
| Filter Sterilize | |
| Store frozen * | |

After maturation in SHaM liquid media, approximately 10 embryos per event are frozen at −80° C., lyophilized and analyzed for oil content and fatty acid profile as described in Example 7.

Results showing oil content and fatty acid profile for approximately 30 transgenic soybean lines (events) from each experiment transformed with RTW218, pKR1684, pKR1685 or pKR1686 are shown in Tables 8, 9, 10 or 11, respectively. Average oil content and fatty acid profile for all events in an experiment is shown in each table as Avg. Average oil content and fatty acid (profile for 5 events having highest oil content in an experiment is shown in each Table as Avg-Top5. In each table, events are sorted based on decreasing oil content.

TABLE 8

Oil Content and Fatty Acid Profile for Soy Somatic Embryos Transformed with RTW218 (YLDGAT1 only).
MSE2692 (RTW218) - YLDGAT1

| Event | Oil | 16:0 | 18:0 | 18:1 | 18:2 | 18:3 |
|---|---|---|---|---|---|---|
| 2692-2 | 10.5 | 12.9 | 6.0 | 32.9 | 39.0 | 9.2 |
| 2692-15 | 10.1 | 14.0 | 5.9 | 29.5 | 41.0 | 9.7 |
| 2692-12 | 9.9 | 13.2 | 5.9 | 28.9 | 41.4 | 10.6 |
| 2692-8 | 9.4 | 13.8 | 7.8 | 31.9 | 36.7 | 9.7 |
| 2692-16 | 9.2 | 11.5 | 6.4 | 35.3 | 35.0 | 11.7 |
| 2692-21 | 8.7 | 13.7 | 7.6 | 32.3 | 36.9 | 9.5 |
| 2692-27 | 8.3 | 13.6 | 7.3 | 32.5 | 35.1 | 11.5 |
| 2692-30 | 8.2 | 13.4 | 6.0 | 30.0 | 38.4 | 12.2 |
| 2692-29 | 8.0 | 13.4 | 7.2 | 30.8 | 38.1 | 10.5 |
| 2692-18 | 7.9 | 14.6 | 6.3 | 25.7 | 41.8 | 11.6 |
| 2692-25 | 7.6 | 14.0 | 8.1 | 31.0 | 35.5 | 11.4 |
| 2692-20 | 7.4 | 14.5 | 5.8 | 24.9 | 40.8 | 13.9 |
| 2692-19 | 7.4 | 14.7 | 6.2 | 27.7 | 39.0 | 12.4 |
| 2692-3 | 7.2 | 14.6 | 6.6 | 26.5 | 40.2 | 12.2 |
| 2692-28 | 6.9 | 16.3 | 6.7 | 23.2 | 40.9 | 12.9 |
| 2692-9 | 6.7 | 15.2 | 7.0 | 24.2 | 40.1 | 13.4 |
| 2692-17 | 6.3 | 15.3 | 6.8 | 23.9 | 40.5 | 13.5 |

TABLE 8-continued

Oil Content and Fatty Acid Profile for Soy Somatic Embryos Transformed with RTW218 (YLDGAT1 only). MSE2692 (RTW218) - YLDGAT1

| Event | Oil | 16:0 | 18:0 | 18:1 | 18:2 | 18:3 |
|---|---|---|---|---|---|---|
| 2692-4 | 6.1 | 16.4 | 5.6 | 17.8 | 44.3 | 15.9 |
| 2692-10 | 5.5 | 15.8 | 6.1 | 24.6 | 39.6 | 13.8 |
| 2692-14 | 5.3 | 16.1 | 6.6 | 25.0 | 38.4 | 13.8 |
| 2692-23 | 5.0 | 17.2 | 5.3 | 16.8 | 42.6 | 18.1 |
| 2692-1 | 5.0 | 16.6 | 5.8 | 15.2 | 44.2 | 18.2 |
| 2692-13 | 4.3 | 15.9 | 5.6 | 21.8 | 39.9 | 16.8 |
| 2692-5 | 4.1 | 16.0 | 6.2 | 20.2 | 40.6 | 17.0 |
| 2692-11 | 3.8 | 17.9 | 6.8 | 19.6 | 39.5 | 16.2 |
| 2692-7 | 3.7 | 16.1 | 5.6 | 20.1 | 39.2 | 18.9 |
| 2692-31 | 3.5 | 17.4 | 5.3 | 19.2 | 39.4 | 18.7 |
| 2692-6 | 3.2 | 16.3 | 5.6 | 15.8 | 41.3 | 21.0 |
| 2692-26 | 3.2 | 18.4 | 7.6 | 19.6 | 36.6 | 17.7 |
| 2692-24 | 3.0 | 17.1 | 5.0 | 15.5 | 39.7 | 22.6 |
| 2692-22 | 1.7 | 15.4 | 6.0 | 16.1 | 41.1 | 21.4 |
| Avg. | 6.4 | 15.2 | 6.4 | 24.5 | 39.6 | 14.4 |
| Avg.-Top5 | 9.8 | 13.1 | 6.4 | 31.7 | 38.6 | 10.2 |

TABLE 9

Oil Content and Fatty Acid Profile for Soy Somatic Embryos Transformed with pKR1684 (YLDGAT1 & GmSut4-1). MSE2689 (pKR1684) - YLDGAT1 & GmSut4-1

| Event | Oil | 16:0 | 18:0 | 18:1 | 18:2 | 18:3 |
|---|---|---|---|---|---|---|
| 2689-8 | 10.8 | 15.1 | 7.7 | 34.6 | 34.9 | 7.8 |
| 2689-5 | 10.5 | 13.0 | 6.4 | 34.5 | 35.3 | 10.8 |
| 2689-14 | 10.3 | 14.0 | 6.7 | 33.4 | 35.6 | 10.3 |
| 2689-11 | 10.2 | 13.2 | 7.0 | 35.5 | 33.5 | 10.8 |
| 2689-22 | 9.9 | 13.3 | 6.2 | 31.2 | 38.2 | 11.1 |
| 2689-19 | 9.3 | 14.0 | 6.5 | 35.0 | 34.6 | 9.9 |
| 2689-13 | 9.3 | 14.3 | 5.9 | 27.1 | 40.6 | 12.1 |
| 2689-4 | 8.5 | 12.8 | 5.9 | 30.7 | 40.0 | 10.6 |
| 2689-23 | 8.5 | 14.5 | 6.7 | 29.6 | 37.1 | 12.1 |
| 2689-1 | 8.4 | 13.2 | 7.0 | 35.3 | 34.6 | 9.9 |
| 2689-24 | 8.3 | 13.3 | 7.5 | 34.8 | 33.3 | 11.1 |
| 2689-9 | 8.1 | 13.6 | 6.7 | 33.5 | 35.5 | 10.7 |
| 2689-17 | 8.0 | 13.7 | 6.7 | 29.1 | 38.1 | 12.4 |
| 2689-28 | 7.8 | 14.1 | 6.6 | 29.8 | 37.4 | 12.1 |
| 2689-10 | 7.8 | 14.0 | 6.4 | 29.2 | 37.6 | 12.8 |
| 2689-29 | 7.5 | 14.2 | 6.4 | 26.4 | 41.5 | 11.4 |
| 2689-3 | 7.4 | 14.8 | 5.8 | 18.5 | 46.0 | 14.8 |
| 2689-26 | 6.4 | 14.7 | 6.5 | 26.7 | 37.7 | 14.5 |
| 2689-2 | 6.3 | 14.3 | 6.8 | 31.8 | 35.6 | 11.5 |
| 2689-21 | 6.0 | 16.2 | 5.0 | 16.9 | 44.9 | 17.0 |
| 2689-6 | 5.8 | 14.6 | 7.0 | 29.4 | 35.9 | 13.2 |
| 2689-12 | 5.5 | 16.3 | 6.8 | 19.7 | 40.7 | 16.5 |
| 2689-25 | 5.4 | 16.2 | 5.9 | 18.0 | 41.8 | 18.0 |
| 2689-20 | 5.2 | 15.4 | 5.5 | 23.9 | 38.5 | 16.8 |
| 2689-15 | 5.2 | 15.0 | 5.9 | 26.3 | 37.4 | 15.5 |
| 2689-16 | 5.0 | 16.3 | 6.6 | 19.6 | 38.1 | 19.4 |
| 2689-27 | 4.7 | 17.9 | 4.9 | 16.5 | 41.5 | 19.1 |
| 2689-7 | 4.3 | 16.7 | 6.2 | 22.9 | 36.1 | 18.1 |
| 2689-30 | 4.1 | 17.4 | 6.8 | 21.8 | 37.5 | 16.5 |
| 2689-18 | 3.8 | 15.5 | 5.8 | 19.1 | 39.4 | 20.2 |
| Avg. | 7.3 | 14.7 | 6.4 | 27.4 | 38.0 | 13.6 |
| Avg.-Top5 | 10.3 | 13.7 | 6.8 | 33.8 | 35.5 | 10.2 |

TABLE 10

Oil Content and Fatty Acid Profile for Soy Somatic Embryos Transformed with pKR1685 (YLDGAT1 & GmSut2-1). MSE2690 (pKR1685) - YLDGAT1 & GmSut2-1

| Event | Oil | 16:0 | 18:0 | 18:1 | 18:2 | 18:3 |
|---|---|---|---|---|---|---|
| 2690-9 | 13.1 | 11.9 | 5.9 | 34.7 | 39.4 | 8.1 |
| 2690-2 | 12.0 | 12.6 | 7.1 | 32.3 | 39.2 | 8.8 |
| 2690-28 | 11.6 | 14.3 | 4.8 | 29.6 | 41.3 | 10.0 |

TABLE 10-continued

Oil Content and Fatty Acid Profile for Soy Somatic Embryos Transformed with pKR1685 (YLDGAT1 & GmSut2-1). MSE2690 (pKR1685) - YLDGAT1 & GmSut2-1

| Event | Oil | 16:0 | 18:0 | 18:1 | 18:2 | 18:3 |
|---|---|---|---|---|---|---|
| 2690-13 | 11.4 | 13.5 | 5.2 | 29.6 | 41.0 | 10.7 |
| 2690-30 | 11.3 | 13.1 | 7.4 | 34.7 | 35.2 | 9.7 |
| 2690-10 | 11.1 | 12.4 | 6.3 | 31.8 | 39.5 | 10.0 |
| 2690-1 | 10.9 | 13.5 | 6.1 | 29.0 | 41.0 | 10.4 |
| 2690-20 | 10.7 | 13.1 | 7.1 | 32.8 | 37.7 | 9.4 |
| 2690-18 | 10.7 | 12.3 | 8.2 | 31.1 | 38.1 | 10.4 |
| 2690-29 | 10.2 | 13.1 | 6.7 | 31.2 | 38.7 | 10.4 |
| 2690-17 | 10.1 | 14.2 | 5.6 | 31.0 | 38.4 | 10.8 |
| 2690-7 | 9.8 | 13.4 | 5.4 | 30.4 | 39.0 | 11.8 |
| 2690-24 | 9.6 | 14.8 | 5.6 | 30.0 | 39.2 | 10.4 |
| 2690-6 | 9.6 | 13.9 | 6.7 | 33.0 | 35.1 | 11.4 |
| 2690-15 | 9.4 | 12.9 | 6.6 | 35.1 | 35.8 | 9.5 |
| 2690-31 | 9.2 | 14.9 | 5.4 | 25.0 | 42.0 | 12.7 |
| 2690-22 | 9.2 | 13.4 | 6.1 | 29.9 | 38.5 | 12.1 |
| 2690-21 | 9.1 | 14.0 | 6.5 | 28.6 | 39.0 | 11.9 |
| 2690-27 | 8.6 | 13.1 | 7.1 | 34.0 | 36.1 | 9.7 |
| 2690-5 | 8.4 | 14.6 | 5.6 | 26.3 | 40.9 | 12.6 |
| 2690-25 | 8.2 | 14.5 | 6.5 | 27.3 | 39.1 | 12.7 |
| 2690-23 | 7.8 | 15.0 | 6.5 | 25.1 | 40.3 | 13.0 |
| 2690-11 | 7.8 | 15.6 | 5.6 | 23.7 | 42.0 | 13.2 |
| 2690-12 | 7.3 | 15.3 | 5.0 | 25.2 | 40.4 | 14.1 |
| 2690-3 | 6.7 | 16.8 | 5.0 | 16.7 | 44.2 | 17.2 |
| 2690-16 | 5.5 | 15.0 | 7.0 | 19.0 | 42.5 | 16.5 |
| 2690-8 | 5.3 | 18.4 | 4.9 | 15.5 | 42.7 | 18.5 |
| 2690-14 | 4.9 | 16.0 | 5.0 | 16.4 | 43.3 | 19.3 |
| 2690-4 | 4.7 | 17.2 | 5.1 | 16.3 | 40.9 | 20.4 |
| 2690-19 | 4.6 | 16.2 | 6.4 | 19.2 | 41.0 | 17.3 |
| 2690-26 | 3.0 | 18.3 | 4.9 | 17.3 | 37.3 | 22.2 |
| Avg. | 8.8 | 14.4 | 6.0 | 27.2 | 39.6 | 12.7 |
| Avg.-Top5 | 11.9 | 13.1 | 6.1 | 32.2 | 39.2 | 9.5 |

TABLE 11

Oil Content and Fatty Acid Profile for Soy Somatic Embryos Transformed with pKR1686 (YLDGAT1 & GmSut4-2). MSE2691 (pKR1686) - YLDGAT1 & GmSut4-2

| Event | Oil | 16:0 | 18:0 | 18:1 | 18:2 | 18:3 |
|---|---|---|---|---|---|---|
| 2691-19 | 12.9 | 12.6 | 7.5 | 36.9 | 34.8 | 8.3 |
| 2691-16 | 12.4 | 12.2 | 6.7 | 33.5 | 38.4 | 9.2 |
| 2691-23 | 12.0 | 12.8 | 7.5 | 37.6 | 33.6 | 8.5 |
| 2691-28 | 11.8 | 13.1 | 5.6 | 26.9 | 44.4 | 10.1 |
| 2691-11 | 11.6 | 13.6 | 6.3 | 27.5 | 42.0 | 10.6 |
| 2691-22 | 10.9 | 13.8 | 5.9 | 26.9 | 42.3 | 11.2 |
| 2691-31 | 10.8 | 13.3 | 6.6 | 27.7 | 42.4 | 10.1 |
| 2691-30 | 10.1 | 15.4 | 5.8 | 25.4 | 41.8 | 11.5 |
| 2691-12 | 10.1 | 13.0 | 7.1 | 31.3 | 38.9 | 9.6 |
| 2691-25 | 9.9 | 15.6 | 6.9 | 23.7 | 42.4 | 11.4 |
| 2691-27 | 9.8 | 13.5 | 7.7 | 31.5 | 37.5 | 9.8 |
| 2691-10 | 9.6 | 12.5 | 7.3 | 31.2 | 39.1 | 9.9 |
| 2691-29 | 9.5 | 17.0 | 4.4 | 17.3 | 47.4 | 13.9 |
| 2691-18 | 9.1 | 14.4 | 7.0 | 30.8 | 36.9 | 10.8 |
| 2691-8 | 8.8 | 16.9 | 4.8 | 17.5 | 46.9 | 13.9 |
| 2691-4 | 8.1 | 17.4 | 4.7 | 18.5 | 44.5 | 14.9 |
| 2691-14 | 7.8 | 13.9 | 6.5 | 26.7 | 40.0 | 12.8 |
| 2691-15 | 7.7 | 15.1 | 6.9 | 27.0 | 38.0 | 13.1 |
| 2691-24 | 6.9 | 14.4 | 6.9 | 28.7 | 35.5 | 14.5 |
| 2691-9 | 6.8 | 14.9 | 6.1 | 27.2 | 38.4 | 13.4 |
| 2691-5 | 6.8 | 17.6 | 5.3 | 17.7 | 43.0 | 16.4 |
| 2691-1 | 6.7 | 16.6 | 5.5 | 20.1 | 43.5 | 14.3 |
| 2691-26 | 5.9 | 17.3 | 5.4 | 16.8 | 43.4 | 17.2 |
| 2691-21 | 5.8 | 17.7 | 5.7 | 18.4 | 42.0 | 16.1 |
| 2691-3 | 5.6 | 17.4 | 4.7 | 14.4 | 44.5 | 19.0 |
| 2691-17 | 5.3 | 16.3 | 6.4 | 21.6 | 38.5 | 17.1 |
| 2691-13 | 5.0 | 16.8 | 6.5 | 22.1 | 38.4 | 16.2 |
| 2691-20 | 4.9 | 15.6 | 5.7 | 17.3 | 43.3 | 18.1 |
| 2691-6 | 4.8 | 16.4 | 6.2 | 17.0 | 41.4 | 19.1 |
| 2691-7 | 4.0 | 15.9 | 5.5 | 16.3 | 41.2 | 21.1 |
| 2691-2 | 4.0 | 18.8 | 5.8 | 17.6 | 39.9 | 18.0 |

TABLE 11-continued

Oil Content and Fatty Acid Profile for Soy Somatic Embryos
Transformed with pKR1686 (YLDGAT1 & GmSut4-2).
MSE2691 (pKR1686) - YLDGAT1 & GmSut4-2

| Event | Oil | 16:0 | 18:0 | 18:1 | 18:2 | 18:3 |
|---|---|---|---|---|---|---|
| Avg. | 8.2 | 15.2 | 6.2 | 24.3 | 40.8 | 13.5 |
| Avg.-Top5 | 12.1 | 12.9 | 6.7 | 32.5 | 38.6 | 9.3 |

A summary of the average oil content and fatty acid profile for the 5 events having highest oil content for each experiment is shown in Table 12. Also shown is the change in oil content compared to the YLDGAT1 only experiment (dOil) as well as the percent increase in oil compared to the YLDGAT1 only experiment (% dOil).

TABLE 12

Average Oil Content and Fatty Acid Profiles for 5 Events having highest
oil content in each experiment.
Average Oil Content and Fatty Acid Profile for Top5 Events per Experiment

| MSE | Vector | Gene 1 | Gene 2 | Oil | dOil | % dOil | 16:0 | 18:0 | 18:1 | 18:2 | 18:3 |
|---|---|---|---|---|---|---|---|---|---|---|---|
| 2692 | RTW218 | YLDGAT1 | — | 9.8 | — | — | 13.1 | 6.4 | 31.7 | 38.6 | 10.2 |
| 2689 | pKR1684 | YLDGAT1 | GmSut4-1 | 10.3 | 0.5 | 5.1% | 13.7 | 6.8 | 33.8 | 35.5 | 10.2 |
| 2690 | pKR1685 | YLDGAT1 | GmSut2-1 | 11.9 | 2.1 | 21.4% | 13.1 | 6.1 | 32.2 | 39.2 | 9.5 |
| 2691 | pKR1686 | YLDGAT1 | GmSut4-2 | 12.1 | 2.3 | 23.9% | 12.9 | 6.7 | 32.5 | 38.6 | 9.3 |

In summary, co-expression of SUT2 and SUT4-type transporters, GmSut4-1, GmSut2-1 and GmSut4-2 showed significant additive effect by further increasing oil contents compared to transgenic embryos with only the YLDGAT1 gene.

Example 15

Co-Expression of Sucrose Transporters and *Yarrowia lipolytica* DGAT2 in Soy

The present example describes cloning soy Sut4 and Sut2 genes, as well as the *Arabidopsis* SUT4His gene, into soy expression vectors and co-expressing with the modified *Yarrowia lipolytica* DGAT2 gene (YLDGAT2mod) (SEQ ID NO: 185) in soy somatic embryos. In all cases, each Sut gene is under control of the soy annexin promoter and YLDGAT2 is under control of the soy glycinin Gy1 promoter.

Construction of pKR1691 (YLDGAT2mod 35Hyg)

Plasmid pKR407 (described in PCT Int. Appl. WO 2008/124048 published on Oct. 16, 2008) was digested with BamHI/HindIII and the fragment containing the Gy1 promoter/NotI/LegA2 terminator cassette was effectively cloned into the BamHI/HindIII fragment of pKR278 (described in PCT Int. Appl. WO 2008/147935 published on Dec. 4, 2008) to produce pKR1468 (SEQ ID NO: 162).

The NotI fragment of pKR1254_Y326F (described in PCT Int. Appl. WO 2008/147935 published on Dec. 4, 2008), containing a modified *Yarrowia lipolytica* DGAT2 (YLDGAT2mod), was cloned into the NotI fragment of pKR1468 (SEQ ID NO: 162), containing the vector backbone with Gy1 promoter, to produce pKR1691 (SEQ ID NO: 163).

Construction of pKR1698 (ATSUT4HIS6 YLDGAT2mod 35Hyg)

The PstI fragment of RTW221 (SEQ ID NO: 134), containing ATSUT4HIS6, was cloned into the SbfI site of pKR1691 (SEQ ID NO: 163) to produce pKR1698 (SEQ ID NO: 164).

Construction of pKR1699 (GmSut4-1 YLDGAT2mod 35Hyg)

The PstI fragment of pKR1680 (SEQ ID NO: 152), containing GmSut4-1, was cloned into the SbfI site of pKR1691 (SEQ ID NO: 163) to produce pKR1699 (SEQ ID NO: 165).

Construction of pKR1700 (GmSut2-1 YLDGAT2mod 35Hyg)

The PstI fragment of pKR1681 (SEQ ID NO: 155), containing GmSut2-1, was cloned into the SbfI site of pKR1691 (SEQ ID NO: 163) to produce pKR1700 (SEQ ID NO: 166).

Construction of pKR1701 (GmSut4-2 YLDGAT2mod 35Hyg)

The SbfI fragment of pKR1682 (SEQ ID NO: 160), containing GmSut4-2, was cloned into the SbfI site of pKR1691 (SEQ ID NO: 163) to produce pKR1701 (SEQ ID NO: 167).

Transgenic soybean lines (cv. Jack) transformed with pKR1691 (SEQ ID NO: 163), pKR1698 (SEQ ID NO: 164), pKR1699 (SEQ ID NO: 165), pKR1700 (SEQ ID NO: 166) or pKR1701 (SEQ ID NO: 167), were generated by particle gun bombardment as described in Example 7. Events were selected, somatic embryos were matured in SHaM media and embryos were analyzed for oil content and fatty acid profile exactly as described in Example 14.

Results showing oil content and fatty acid profile for approximately 30 transgenic soybean lines (events) from each experiment transformed with pKR1698 (SEQ ID NO: 164), pKR1699 (SEQ ID NO: 165), pKR1700 (SEQ ID NO: 166) or pKR1701 (SEQ ID NO: 167) are shown in Tables 13, 14, 15, 16 or 17, respectively. Average oil content and fatty acid profile for all events in an experiment is shown in each table as Avg. Average oil content and fatty acid profile for 5 events having highest oil content in an experiment is shown in each Table as Avg-Top5. In each table, events are sorted based on decreasing oil content.

TABLE 13

Oil Content and Fatty Acid Profile for Soy Somatic Embryos
Transformed with pKR1691 (YLDGAT2mod only).
MSE2702 (pKR1691) - YLDGAT2mod

| Event | Oil | 16:0 | 18:0 | 18:1 | 18:2 | 18:3 |
|---|---|---|---|---|---|---|
| 2702-10 | 10.1 | 12.7 | 5.8 | 32.4 | 38.8 | 10.3 |
| 2702-29 | 8.5 | 14.0 | 5.7 | 25.1 | 42.0 | 13.2 |
| 2702-5 | 8.1 | 13.9 | 5.6 | 25.9 | 40.6 | 14.0 |
| 2702-27 | 7.1 | 14.1 | 5.3 | 27.1 | 39.5 | 13.9 |
| 2702-16 | 6.9 | 14.6 | 5.5 | 27.3 | 38.5 | 14.1 |
| 2702-23 | 6.9 | 15.6 | 4.9 | 18.6 | 44.7 | 16.1 |
| 2702-7 | 6.7 | 13.7 | 7.3 | 31.1 | 35.3 | 12.6 |
| 2702-2 | 6.7 | 15.4 | 4.8 | 16.6 | 45.8 | 17.4 |

TABLE 13-continued

Oil Content and Fatty Acid Profile for Soy Somatic Embryos Transformed with pKR1691 (YLDGAT2mod only).
MSE2702 (pKR1691) - YLDGAT2mod

| Event | Oil | 16:0 | 18:0 | 18:1 | 18:2 | 18:3 |
|---|---|---|---|---|---|---|
| 2702-9 | 5.7 | 17.2 | 5.7 | 19.2 | 41.8 | 16.1 |
| 2702-21 | 5.5 | 15.4 | 5.1 | 20.9 | 41.4 | 17.3 |
| 2702-4 | 5.4 | 15.3 | 6.3 | 25.0 | 37.7 | 15.7 |
| 2702-28 | 5.3 | 17.9 | 5.7 | 19.5 | 39.7 | 17.2 |
| 2702-18 | 5.2 | 16.3 | 5.1 | 16.7 | 42.5 | 19.5 |
| 2702-14 | 4.9 | 15.0 | 5.1 | 16.8 | 43.5 | 19.5 |
| 2702-13 | 4.9 | 16.6 | 4.5 | 15.8 | 43.3 | 19.8 |
| 2702-24 | 4.8 | 16.1 | 6.3 | 20.1 | 40.9 | 16.5 |
| 2702-20 | 4.7 | 15.7 | 5.7 | 21.0 | 39.9 | 17.7 |
| 2702-15 | 4.3 | 17.0 | 4.9 | 15.1 | 42.4 | 20.7 |
| 2702-6 | 4.3 | 16.4 | 5.6 | 17.4 | 41.9 | 18.6 |
| 2702-12 | 4.1 | 15.5 | 6.5 | 22.7 | 37.3 | 18.1 |
| 2702-26 | 4.1 | 16.1 | 4.7 | 15.3 | 42.3 | 21.6 |
| 2702-1 | 3.9 | 16.2 | 6.1 | 19.7 | 39.5 | 18.4 |
| 2702-22 | 3.8 | 17.1 | 5.7 | 17.9 | 40.5 | 18.8 |
| 2702-3 | 3.6 | 16.3 | 4.9 | 14.5 | 42.3 | 22.0 |
| 2702-8 | 3.6 | 17.7 | 5.0 | 15.2 | 40.8 | 21.2 |
| 2702-25 | 3.4 | 17.6 | 5.3 | 16.4 | 40.0 | 20.6 |
| 2702-17 | 3.3 | 17.3 | 5.3 | 17.9 | 37.8 | 21.8 |
| 2702-30 | 3.1 | 18.1 | 5.4 | 17.0 | 38.5 | 21.0 |
| 2702-19 | 3.0 | 17.8 | 5.7 | 17.0 | 39.4 | 20.0 |
| 2702-11 | 3.0 | 18.1 | 5.4 | 15.3 | 40.7 | 20.5 |
| Avg. | 5.2 | 16.0 | 5.5 | 20.0 | 40.7 | 17.8 |
| Avg.-Top5 | 8.1 | 13.9 | 5.6 | 27.6 | 39.9 | 13.1 |

TABLE 14

Oil Content and Fatty Acid Profile for Soy Somatic Embryos Transformed with pKR1698 (YLDGAT2mod & ATSUT4HIS6).
MSE2703 (pKR1698) - YLDGAT2mod & AtSUT4HIS6

| Event | Oil | 16:0 | 18:0 | 18:1 | 18:2 | 18:3 |
|---|---|---|---|---|---|---|
| 2703-2 | 12.5 | 12.4 | 5.2 | 34.3 | 39.2 | 8.9 |
| 2703-13 | 11.5 | 13.2 | 4.5 | 29.3 | 41.3 | 11.8 |
| 2703-22 | 9.9 | 13.3 | 5.6 | 30.0 | 40.2 | 10.9 |
| 2703-3 | 8.9 | 13.4 | 6.4 | 30.0 | 39.3 | 11.0 |
| 2703-7 | 7.9 | 13.5 | 5.9 | 30.8 | 37.5 | 12.3 |
| 2703-27 | 7.8 | 15.0 | 5.8 | 29.0 | 37.1 | 13.1 |
| 2703-26 | 7.2 | 13.8 | 6.8 | 32.7 | 35.0 | 11.6 |
| 2703-8 | 7.0 | 14.5 | 5.0 | 25.8 | 40.7 | 14.0 |
| 2703-14 | 6.2 | 14.4 | 6.0 | 28.3 | 37.4 | 14.0 |
| 2703-18 | 5.8 | 14.6 | 6.0 | 29.0 | 37.2 | 13.1 |
| 2703-15 | 5.8 | 17.7 | 4.9 | 18.2 | 42.9 | 16.2 |
| 2703-29 | 5.7 | 16.5 | 5.9 | 23.4 | 39.6 | 14.7 |
| 2703-6 | 5.2 | 16.0 | 4.8 | 18.0 | 42.0 | 18.9 |
| 2703-23 | 4.9 | 16.6 | 5.7 | 21.0 | 38.8 | 17.8 |
| 2703-9 | 4.9 | 17.6 | 4.5 | 17.1 | 42.7 | 18.1 |
| 2703-10 | 4.9 | 15.5 | 5.5 | 27.2 | 35.9 | 15.9 |
| 2703-16 | 4.4 | 17.0 | 5.3 | 20.2 | 40.3 | 17.2 |
| 2703-17 | 4.3 | 16.7 | 6.1 | 22.6 | 38.4 | 16.2 |
| 2703-5 | 4.1 | 16.8 | 6.0 | 19.7 | 42.6 | 15.0 |
| 2703-21 | 4.0 | 18.8 | 4.1 | 17.3 | 38.0 | 21.9 |
| 2703-24 | 4.0 | 15.7 | 4.4 | 20.0 | 40.3 | 19.6 |
| 2703-1 | 3.7 | 14.9 | 5.0 | 17.6 | 39.9 | 22.5 |
| 2703-11 | 3.7 | 17.4 | 6.1 | 22.6 | 35.8 | 18.1 |
| 2703-28 | 3.5 | 17.5 | 5.3 | 17.8 | 39.5 | 19.9 |
| 2703-19 | 3.5 | 13.3 | 5.4 | 17.3 | 43.3 | 20.7 |
| 2703-30 | 3.3 | 16.8 | 5.6 | 18.6 | 40.3 | 18.8 |
| 2703-12 | 3.3 | 16.6 | 5.3 | 23.0 | 34.0 | 21.0 |
| 2703-25 | 3.2 | 16.7 | 5.2 | 18.6 | 38.4 | 21.1 |
| 2703-4 | 3.1 | 16.5 | 5.7 | 20.3 | 37.8 | 19.7 |
| 2703-20 | 2.6 | 17.2 | 4.8 | 15.0 | 42.1 | 20.9 |
| Avg. | 5.6 | 15.7 | 5.4 | 23.2 | 39.2 | 16.5 |
| Avg.-Top5 | 10.1 | 13.2 | 5.5 | 30.9 | 39.5 | 11.0 |

TABLE 15

Oil Content and Fatty Acid Profile for Soy Somatic Embryos Transformed with pKR1699 (YLDGAT2mod & GmSut4-1).
MSE2704 (pKR1699) - YLDGAT2mod & GmSut4-1

| Event | Oil | 16:0 | 18:0 | 18:1 | 18:2 | 18:3 |
|---|---|---|---|---|---|---|
| 2704-10 | 16.3 | 10.8 | 4.8 | 38.0 | 38.6 | 7.8 |
| 2704-19 | 12.6 | 12.4 | 5.2 | 33.5 | 40.4 | 8.5 |
| 2704-21 | 10.7 | 13.7 | 4.5 | 27.5 | 42.3 | 11.9 |
| 2704-30 | 9.1 | 15.5 | 4.8 | 21.8 | 44.7 | 13.3 |
| 2704-6 | 8.9 | 14.0 | 6.4 | 35.3 | 33.6 | 10.7 |
| 2704-12 | 8.0 | 13.7 | 6.5 | 30.6 | 38.1 | 11.2 |
| 2704-20 | 7.7 | 14.1 | 6.0 | 30.5 | 36.6 | 12.9 |
| 2704-26 | 7.7 | 13.9 | 5.9 | 30.3 | 37.5 | 12.4 |
| 2704-9 | 7.3 | 15.1 | 6.0 | 24.8 | 39.6 | 14.6 |
| 2704-22 | 6.6 | 15.2 | 6.3 | 27.8 | 38.1 | 12.7 |
| 2704-23 | 6.0 | 17.0 | 4.9 | 19.6 | 42.3 | 16.2 |
| 2704-28 | 5.8 | 16.7 | 4.5 | 15.3 | 45.4 | 18.1 |
| 2704-2 | 5.7 | 16.5 | 5.4 | 16.9 | 43.0 | 18.2 |
| 2704-15 | 5.7 | 17.2 | 5.2 | 17.6 | 43.1 | 16.9 |
| 2704-18 | 5.3 | 16.0 | 5.3 | 23.2 | 39.0 | 16.4 |
| 2704-29 | 5.2 | 16.9 | 6.0 | 27.3 | 35.8 | 14.1 |
| 2704-7 | 5.2 | 16.3 | 5.4 | 19.7 | 42.3 | 16.5 |
| 2704-17 | 5.1 | 17.2 | 4.8 | 15.6 | 43.8 | 18.5 |
| 2704-11 | 5.0 | 15.2 | 5.5 | 18.1 | 42.6 | 18.5 |
| 2704-5 | 4.9 | 16.8 | 5.6 | 20.9 | 39.6 | 17.1 |
| 2704-8 | 4.8 | 16.6 | 6.3 | 24.4 | 34.9 | 17.8 |
| 2704-1 | 4.8 | 16.4 | 5.5 | 21.1 | 39.6 | 17.3 |
| 2704-16 | 4.7 | 17.4 | 4.9 | 16.8 | 42.2 | 18.7 |
| 2704-25 | 4.7 | 19.0 | 5.1 | 18.4 | 38.7 | 18.9 |
| 2704-27 | 4.6 | 18.7 | 5.8 | 19.8 | 37.9 | 17.8 |
| 2704-4 | 4.6 | 15.1 | 6.4 | 25.5 | 38.0 | 15.0 |
| 2704-24 | 4.5 | 16.8 | 5.4 | 19.1 | 40.7 | 18.0 |
| 2704-13 | 4.5 | 18.1 | 4.9 | 15.2 | 42.8 | 19.0 |
| 2704-3 | 3.7 | 16.7 | 6.0 | 22.5 | 37.0 | 17.8 |
| 2704-14 | 3.0 | 17.8 | 5.8 | 18.1 | 38.0 | 20.3 |
| Avg. | 6.4 | 15.9 | 5.5 | 23.2 | 39.9 | 15.6 |
| Avg.-Top5 | 11.5 | 13.3 | 5.1 | 31.2 | 39.9 | 10.4 |

TABLE 16

Oil Content and Fatty Acid Profile for Soy Somatic Embryos Transformed with pKR1700 (YLDGAT2mod & GmSut2-1).
MSE2705 (pKR1700) - YLDGAT2mod & GmSut2-1

| Event | Oil | 16:0 | 18:0 | 18:1 | 18:2 | 18:3 |
|---|---|---|---|---|---|---|
| 2705-9 | 10.5 | 13.6 | 6.2 | 32.3 | 38.2 | 9.6 |
| 2705-16 | 9.5 | 15.6 | 4.4 | 19.3 | 48.5 | 12.1 |
| 2705-1 | 9.5 | 15.5 | 5.8 | 21.2 | 45.9 | 11.6 |
| 2705-3 | 9.3 | 14.4 | 7.1 | 31.5 | 37.3 | 9.8 |
| 2705-8 | 9.2 | 13.7 | 6.1 | 29.8 | 40.0 | 10.4 |
| 2705-12 | 8.6 | 12.9 | 5.7 | 30.9 | 39.6 | 10.9 |
| 2705-27 | 8.4 | 13.6 | 5.3 | 29.9 | 39.2 | 12.0 |
| 2705-7 | 7.8 | 15.3 | 6.0 | 20.9 | 44.5 | 13.3 |
| 2705-17 | 7.4 | 16.6 | 7.5 | 23.6 | 40.0 | 12.3 |
| 2705-6 | 7.3 | 15.6 | 6.9 | 22.9 | 42.9 | 11.7 |
| 2705-5 | 7.1 | 16.9 | 5.1 | 19.7 | 44.0 | 14.2 |
| 2705-23 | 6.6 | 16.8 | 5.3 | 19.0 | 43.4 | 15.6 |
| 2705-13 | 6.4 | 15.4 | 6.1 | 21.3 | 41.7 | 15.6 |
| 2705-30 | 6.2 | 13.9 | 6.3 | 27.3 | 38.5 | 14.1 |
| 2705-29 | 6.2 | 16.1 | 7.2 | 22.8 | 38.9 | 15.0 |
| 2705-10 | 5.9 | 14.1 | 6.3 | 29.5 | 37.3 | 12.9 |
| 2705-28 | 5.8 | 17.1 | 5.3 | 19.9 | 42.5 | 15.2 |
| 2705-11 | 5.6 | 15.9 | 7.6 | 22.7 | 39.8 | 14.0 |
| 2705-15 | 5.6 | 16.6 | 5.9 | 19.7 | 42.2 | 15.7 |
| 2705-19 | 5.3 | 16.6 | 5.7 | 22.4 | 40.4 | 15.0 |
| 2705-2 | 5.2 | 15.1 | 4.8 | 15.9 | 46.5 | 17.7 |
| 2705-21 | 4.9 | 16.5 | 6.6 | 24.4 | 38.5 | 14.0 |
| 2705-22 | 4.9 | 16.3 | 5.1 | 18.6 | 41.5 | 18.4 |
| 2705-14 | 4.9 | 16.0 | 7.2 | 20.5 | 40.0 | 16.2 |
| 2705-4 | 4.8 | 18.8 | 6.1 | 21.0 | 38.7 | 15.5 |
| 2705-31 | 4.7 | 17.3 | 6.7 | 18.7 | 40.3 | 17.0 |
| 2705-24 | 4.5 | 17.2 | 4.9 | 17.0 | 42.1 | 18.9 |
| 2705-20 | 4.1 | 16.8 | 6.5 | 20.3 | 38.5 | 17.9 |
| 2705-25 | 4.1 | 14.8 | 4.3 | 16.1 | 42.8 | 22.0 |
| 2705-18 | 3.7 | 17.5 | 4.0 | 16.5 | 42.9 | 19.1 |

TABLE 16-continued

Oil Content and Fatty Acid Profile for Soy Somatic Embryos Transformed with pKR1700 (YLDGAT2mod & GmSut2-1). MSE2705 (pKR1700) - YLDGAT2mod & GmSut2-1

| Event | Oil | 16:0 | 18:0 | 18:1 | 18:2 | 18:3 |
|---|---|---|---|---|---|---|
| 2705-26 | 3.7 | 17.8 | 6.0 | 18.4 | 39.3 | 18.4 |
| Avg. | 6.4 | 15.8 | 5.9 | 22.4 | 41.2 | 14.7 |
| Avg.-Top5 | 9.6 | 14.6 | 6.0 | 26.8 | 42.0 | 10.7 |

TABLE 17

Oil Content and Fatty Acid Profile for Soy Somatic Embryos Transformed with pKR1701 (YLDGAT2mod & GmSut4-2). MSE2706 (pKR1701) - YLDGAT2mod & GmSut4-2.

| Event | Oil | 16:0 | 18:0 | 18:1 | 18:2 | 18:3 |
|---|---|---|---|---|---|---|
| 2706-13 | 10.9 | 11.2 | 8.3 | 38.7 | 34.6 | 7.2 |
| 2706-16 | 8.2 | 14.0 | 7.0 | 33.3 | 36.3 | 9.4 |
| 2706-6 | 7.9 | 14.3 | 6.7 | 28.9 | 39.0 | 11.1 |
| 2706-2 | 7.7 | 16.2 | 4.0 | 19.7 | 45.4 | 14.8 |
| 2706-3 | 7.3 | 14.9 | 6.3 | 28.9 | 37.9 | 12.1 |
| 2706-1 | 6.5 | 12.7 | 5.7 | 34.3 | 36.1 | 11.2 |
| 2706-29 | 6.3 | 17.4 | 5.6 | 17.9 | 40.8 | 18.3 |
| 2706-24 | 5.9 | 15.1 | 6.8 | 27.8 | 36.7 | 13.6 |
| 2706-19 | 5.8 | 15.4 | 6.6 | 27.5 | 37.1 | 13.4 |
| 2706-10 | 5.8 | 17.1 | 5.9 | 26.2 | 35.5 | 15.2 |
| 2706-27 | 5.8 | 16.1 | 5.0 | 21.3 | 41.5 | 16.1 |
| 2706-26 | 5.7 | 15.8 | 6.2 | 26.9 | 37.3 | 14.0 |
| 2706-4 | 5.7 | 15.8 | 5.1 | 18.8 | 38.8 | 21.5 |
| 2706-30 | 5.6 | 16.2 | 7.0 | 26.4 | 36.6 | 13.8 |
| 2706-20 | 5.5 | 17.7 | 6.3 | 21.0 | 37.7 | 17.3 |
| 2706-28 | 5.3 | 15.3 | 5.4 | 26.0 | 39.9 | 13.4 |
| 2706-18 | 5.1 | 15.2 | 5.6 | 25.3 | 39.3 | 14.6 |
| 2706-8 | 4.9 | 16.9 | 6.0 | 24.2 | 36.4 | 16.5 |
| 2706-22 | 4.6 | 19.3 | 4.6 | 17.5 | 39.7 | 19.0 |
| 2706-14 | 4.6 | 17.3 | 6.5 | 23.3 | 37.7 | 15.3 |
| 2706-25 | 4.5 | 18.1 | 4.9 | 17.7 | 41.3 | 18.0 |
| 2706-12 | 4.5 | 18.5 | 5.0 | 15.9 | 39.6 | 21.1 |
| 2706-9 | 4.2 | 16.5 | 5.3 | 24.4 | 36.8 | 17.0 |
| 2706-17 | 4.0 | 17.0 | 6.5 | 22.2 | 36.2 | 18.1 |
| 2706-7 | 3.7 | 17.6 | 6.4 | 22.1 | 37.3 | 16.6 |
| 2706-15 | 3.5 | 17.8 | 6.2 | 21.2 | 36.0 | 18.7 |
| 2706-21 | 3.3 | 17.8 | 6.0 | 18.1 | 39.1 | 18.9 |
| 2706-11 | 3.3 | 17.5 | 4.9 | 18.1 | 38.5 | 20.9 |
| 2706-23 | 2.8 | 17.7 | 4.9 | 15.5 | 40.2 | 21.7 |
| 2706-5 | 2.5 | 16:3 | 5.7 | 14.4 | 35.9 | 27.7 |
| Avg. | 5.4 | 16.3 | 5.9 | 23.4 | 38.2 | 16.2 |
| Avg.-Top5 | 8.4 | 14.1 | 6.4 | 29.9 | 38.6 | 10.9 |

A summary of the average oil content and fatty acid profile for the 5 events having highest oil content for each experiment is shown in Table 18. Also shown is the change in oil content compared to the YLDGAT1 only experiment (dOil) as well as the percent increase in oil compared to the YLDGAT1 only experiment (% dOil).

showed significant additive effect by further increasing oil contents compared to transgenic embryos with only the YLDGAT2mod gene.

Example 16

Co-Expression of Sucrose Transporters and *Yarrowia lipolytica* DGAT2 in Soy The present example describes cloning a soy Sut4 gene (GmSut4-1) into a soy expression vector and co-expressing with the modified *Yarrowia lipolytica* DGAT2 gene (YLDGAT2mod) in soy somatic embryos. GmSut4-1 is under control of the soy beta-conglycinin promoter and YLDGAT2mod is under control of the soy glycinin Gy1 promoter.

Construction of pKR1602 (YLDGAT2mod ALS)

Plasmid QC477 (described in US Publication No. US 2010-0162436 published on Jun. 24, 2010), which contains the soybean acetolactate synthase (als) gene coding region encoding a mutant ALS enzyme insensitive to sulfonylurea herbicides, was digested with NotI, the fragment ends were filled to blunt and the fragment was religated to produce pKR1363 (SEQ ID NO: 168). In this way, the NotI site was effectively removed.

The NotI fragment of pKR1316 (described in PCT Int. Appl. WO 2009/143401 published on Nov. 26, 2009), containing a codon optimized *Yarrowia* DGAT1 (YLDGAT1cod2), was cloned into the NotI fragment of pKR1104 (described in PCT Int. Appl. WO 2008/124048 published on Oct. 16, 2008), containing the vector backbone with soy beta-conglycinin promoter, to produce pKR1331 (SEQ ID NO: 169).

Plasmid pKR1331 (SEQ ID NO: 169) was digested with BamHI/HindIII, fragment ends were completely filled to blunt and the fragment containing YLDGAT1cod2 was then cloned into the PmeI site of pKR1363 (SEQ ID NO: 168) to produce pKR1365 (SEQ ID NO: 170).

The NotI fragment of pKR1254_Y326F (described in PCT Int. Appl. WO 2008/147935 published on Dec. 4, 2008), containing a modified *Yarrowia* DGAT2 (YLDGAT2mod), was cloned into the NotI fragment of pKR1365 (SEQ ID NO: 170), containing the vector backbone with soy beta-conglycinin promoter, to produce pKR 1374 (SEQ ID NO: 171).

The XbaI/NheI fragment of pKR263 (described in PCT Int. Appl. WO 2004/071467 published on Aug. 26, 2004), containing the Gy1 promoter/leg terminator cassette, was cloned into the XbaI site of pNEB193 (New England

TABLE 18

Average Oil Content and Fatty Acid Profiles for 5 Events having highest oil content in each experiment.

| Experiment | Vector | Gene 1 | Gene 2 | Oil | dOil | % dOil | 16:0 | 18:0 | 18:1 | 18:2 | 18:3 |
|---|---|---|---|---|---|---|---|---|---|---|---|
| MSE2702 | pKR1691 | YLDGAT2mod | — | 8.1 | — | — | 13.9 | 5.6 | 27.6 | 39.9 | 13.1 |
| MSE2703 | pKR1698 | YLDGAT2mod | AtSUT4HIS6 | 10.1 | 2.0 | 24.7% | 13.2 | 5.5 | 30.9 | 39.5 | 11 |
| MSE2704 | pKR1699 | YLDGAT2mod | GmSut4-1 | 11.5 | 3.4 | 42.0% | 13.3 | 5.1 | 31.2 | 39.9 | 10.4 |
| MSE2705 | pKR1700 | YEDGAT2mod | GmSut2-1 | 9.6 | 1.5 | 18.5% | 14.6 | 6.0 | 26.8 | 42.0 | 10.7 |
| MSE2706 | pKR1701 | YLDGAT2mod | GmSut4-2 | 8.4 | 0.3 | 3.7% | 14.1 | 6.4 | 29.9 | 38.6 | 10.9 |

In summary, co-expression of SUT2 and SUT4-type transporters, ATSUT4HIS6, GmSut4-1 and GmSut2-1

Biolabs, Ipswich, Mass.) to produce pKR1598 (SEQ ID NO: 172).

The NotI fragment of pKR1374 (SEQ ID NO: 171), containing YLDGAT2mod, was cloned into the NotI site of pKR1598 (SEQ ID NO: 172) to produce pKR1600 (SEQ ID NO: 173).

The SbfI/BsiWI fragment of pKR1600 (SEQ ID NO: 173), containing YLDGAT2mod, was cloned into the SbfI/BsiWI fragment of pKR1374 (SEQ ID NO: 171), containing the vector backbone with ALS selection marker, to produce pKR1602 (SEQ ID NO: 174).

Construction of pKR1661 (GmSut4-1 YLDGAT2mod ALS)

The NotI fragment of Glyma02g38300 in pGEM-T Easy (SEQ ID NO: 151), containing GmSut4-1, was cloned into the NotI site of pKR1365 (SEQ ID NO: 170) to produce pKR1658 (SEQ ID NO: 175).

The BsiWI fragment of pKR1658 (SEQ ID NO: 175), containing GmSut4-1, was cloned into the BsiWI site of pKR1602 (SEQ ID NO: 174) to produce pKR1661 (SEQ ID NO: 176).

Transgenic soybean lines transformed with pKR1602 (SEQ ID NO: 174) or pKR1661 (SEQ ID NO: 176), were generated by particle gun bombardment as described in Example 7 with the following modifications. Soy embryogenic suspension cultures (cv. 93B86) were grown at a light intensity of 80-100 µE/m²/s and were subcultured every 7-14 days by inoculating up to ½ dime sized quantities of tissue into 50 mL of fresh liquid SB196. During tissue bombardment, only 100 mg of two-week old suspension culture is transformed (vs 150-250 mg described in Example 7). Total time in selection on SU is for 13 weeks vs 8-12 as described in Example 7.

Events were analyzed at the somatic embryo stage for oil content and fatty acid profile exactly as described in Example 7. Results showing oil content and fatty acid profile for transgenic soybean lines (events) from each experiment transformed with pKR1602 (SEQ ID NO: 174) or pKRI661 (SEQ ID NO: 176) are shown in Tables 19 or 20, respectively. Average oil content and fatty acid profile for all events in an experiment is shown in each table as Avg. Average oil content and fatty acid profile for 5 events having highest oil content in an experiment is shown in each Table as Avg-Top5. In each table, events are sorted based on decreasing oil content.

TABLE 19

Oil Content and Fatty Acid Profile for Soy Somatic Embryos Transform with pKR1602 (YLDGAT2mod).
Oil60 (pKR1602) - YLDGAT2mod

| Event | Oil | 16:0 | 18:0 | 18:1 | 18:2 | 18:3 |
|---|---|---|---|---|---|---|
| AFS 7220-11-2 | 8.7 | 15.3 | 5.2 | 15.1 | 51.7 | 12.7 |
| AFS 7501-12-1 | 8.0 | 12.7 | 4.3 | 29.4 | 40.7 | 13.0 |
| AFS 7220-9-1 | 7.7 | 13.7 | 7.8 | 16.9 | 47.8 | 13.7 |
| AFS 7501-10-1 | 7.3 | 12.1 | 5.0 | 30.7 | 39.6 | 12.6 |
| AFS 7501-7-1 | 7.0 | 15.3 | 4.0 | 20.8 | 46.4 | 13.5 |
| AFS 7220-1-1 | 6.6 | 13.3 | 7.2 | 30.8 | 39.5 | 9.3 |
| AFS 7501-1-1 | 6.3 | 14.4 | 4.4 | 27.5 | 40.3 | 13.4 |
| AFS 7220-4-1 | 5.4 | 14.2 | 7.9 | 17.9 | 46.5 | 13.6 |

TABLE 19-continued

Oil Content and Fatty Acid Profile for Soy Somatic Embryos Transform with pKR1602 (YLDGAT2mod).
Oil60 (pKR1602) - YLDGAT2mod

| Event | Oil | 16:0 | 18:0 | 18:1 | 18:2 | 18:3 |
|---|---|---|---|---|---|---|
| AFS 7220-10-1 | 4.5 | 13.1 | 8.0 | 26.2 | 42.0 | 10.7 |
| AFS 7501-12-2 | 4.2 | 14.5 | 4.4 | 24.9 | 40.4 | 15.7 |
| AFS 7501-6-1 | 4.2 | 15.8 | 4.3 | 22.4 | 40.9 | 16.6 |
| AFS 7220-10-2 | 3.8 | 17.0 | 6.5 | 19.5 | 43.8 | 13.1 |
| AFS 7501-12-3 | 3.6 | 15.8 | 5.0 | 21.4 | 39.7 | 18.0 |
| AFS 7220-11-1 | 3.6 | 13.5 | 6.6 | 19.0 | 47.6 | 13.4 |
| Avg. | 5.8 | 14.3 | 5.8 | 23.0 | 43.3 | 13.5 |
| Avg.-Top5 | 7.7 | 13.8 | 5.3 | 22.6 | 45.2 | 13.1 |

TABLE 20

Oil Content and Fatty Acid Profile for Soy Somatic Embryos Transformed with pKR1661 (YLDGAT2mod & GmSut4-1).
Oil79 (pKR1661) - YlDGAT2mod & GmSut4-1

| Event | Oil | 16:0 | 18:0 | 18:1 | 18:2 | 18:3 |
|---|---|---|---|---|---|---|
| AFS 7162-10-16 | 11.4 | 14.3 | 5.5 | 29.4 | 39.0 | 11.8 |
| AFS 7162-10-15 | 9.8 | 11.3 | 5.4 | 37.5 | 36.8 | 9.0 |
| AFS 7162-10-4 | 9.0 | 10.2 | 4.3 | 33.0 | 41.8 | 10.7 |
| AFS 7162-10-1 | 8.8 | 10.8 | 5.3 | 34.8 | 39.1 | 9.9 |
| AFS 7162-10-7 | 8.5 | 14.9 | 4.5 | 23.6 | 45.7 | 11.3 |
| AFS 7162-5-2 | 8.2 | 11.8 | 6.0 | 30.0 | 40.1 | 12.0 |
| AFS 7162-10-5 | 8.1 | 10.3 | 5.0 | 40.2 | 35.4 | 9.1 |
| AFS 7162-10-17 | 8.0 | 12.6 | 6.5 | 35.7 | 35.0 | 10.2 |
| AFS 7162-10-11 | 7.3 | 12.1 | 5.1 | 30.4 | 39.1 | 13.2 |
| AFS 7162-10-14 | 7.3 | 15.3 | 5.7 | 23.2 | 37.9 | 17.9 |
| AFS 7162-10-2 | 7.3 | 10.6 | 6.2 | 41.6 | 32.3 | 9.4 |
| AFS 7162-10-9 | 7.0 | 11.1 | 5.0 | 35.5 | 36.8 | 11.5 |
| ARS 7162-10-12 | 6.6 | 12.4 | 6.0 | 41.9 | 30.3 | 9.4 |
| AFS 7162-10-10 | 6.4 | 11.8 | 5.2 | 33.4 | 38.5 | 11.2 |
| AFS 7162-10-3 | 5.7 | 12.5 | 4.3 | 21.7 | 44.4 | 17.0 |
| AFS 7162-10-6 | 5.5 | 17.4 | 4.3 | 17.0 | 45.0 | 16.3 |
| AFS 7162-5-1 | 5.5 | 12.6 | 5.7 | 25.5 | 41.7 | 14.6 |
| AFS 7162-10-8 | 5.4 | 14.2 | 4.3 | 25.8 | 40.4 | 15.3 |
| AFS 7162-10-13 | 5.4 | 13.2 | 4.4 | 21.8 | 44.8 | 15.9 |
| AFS 7162-5-3 | 5.3 | 13.2 | 7.5 | 33.4 | 31.8 | 14.0 |
| Avg. | 7.3 | 12.6 | 5.3 | 30.8 | 38.8 | 12.5 |
| Avg.-Top5 | 9.5 | 12.3 | 5.0 | 31.7 | 40.5 | 10.6 |

A summary of the average oil content and fatty acid profile for the 5 events having highest oil content for each experiment is shown in Table 21 Also shown is the change in oil content compared to the YLDGAT1 only experiment (dOil) as well as the percent increase in oil compared to the YLDGAT1 only experiment (% dOil).

TABLE 21

Average Oil Content and Fatty Acid Profiles for 5 Events having oil content in each experiment.
Averarge Oil Content and Fatty Acid Profile for Top5 Events per Experiment

| Experiment | Vector | Gene 1 | Gene 2 | Oil | dOil | % dOil | 16:0 | 18:0 | 18:1 | 18:2 | 18:3 |
|---|---|---|---|---|---|---|---|---|---|---|---|
| Oil60 | pKR1602 | YEDGAT2mod | — | 7.7 | — | — | 13.8 | 5.3 | 22.6 | 45.2 | 13.1 |
| Oil79 | pKR1661 | YLDGAT2mod | GmSut4-1 | 9.5 | 1.8 | 23.3% | 12.3 | 5.0 | 31.7 | 40.5 | 10.6 |

In summary, co-expression of GmSut4-1 showed significant additive effect by further increasing oil contents compared to transgenic embryos with only the YLDGAT2mod gene.

Example 17

Co-Expression of *Yarrowia lipolytica* DGAT Genes and Low Affinity, High Capacity Sucrose Transporter Genes in Soybean Seed T1 seed from event AFS 5925.1.9.2 (3 transgenic HiOil/Increased Oleic segregants; 1 null segregant) and AES 5925.2.7.1 (9 transgenic HiOil/Increased Oleic segregants; 2 null segregants), which were described in Example 8 (Table 7), were planted and plants grown as described supra. T2 seed were harvested and 16 seeds from each seed were analyzed for oil content and fatty acid profile as described supra. Based on the oil content and fatty acid profiles for T2 seed from each plant, 1 plant from event AFS 5925.1.9.2 and 1 plant from event AFS 5925.2.7.1 were identified to be homozygous for the transgene as all 16 seed analyzed displayed the HiOil/Increased Oleic phenotype.

The oil content and fatty acid profiles for seed from homozygous plants (Homoz) as well as the null segregants (Null) for each event are shown in Table 22. In Table 22, "Avg." indicates the average oil content or fatty acid profile for all T2 seed from that plant. In Table 22, Null Avg, indicates the average oil content and fatty acid profile for T2 seed from all Null plants from AFS 5925.2.7.1. Data are presented as decreasing oleic acid content in each seed for each plant. Oil content from 2 wild-type soybean seed (cv. Jack) is also shown.

TABLE 22

Oil Content and Fatty Acid Profile of T2 Soybean Seed Generated with PHP 36710

| Event | Plant | Seed | % oil | % 16:0 | % 18:0 | % 18:1 | % 18:2 | % 18:3 | Segregant Type |
|---|---|---|---|---|---|---|---|---|---|
| AFS 5925.1.9.2 | 9GR22-74 | 9GR22-74-1 | 20.4 | 12.6 | 3.7 | 14.8 | 57.4 | 11.5 | Null |
| AFS 5925.1.9.2 | 9GR22-74 | 9GR22-74-16 | 21.2 | 13.4 | 3.6 | 14.3 | 58.2 | 10.5 | Null |
| AFS 5925.1.9.2 | 9GR22-74 | 9GR22-74-12 | 20.9 | 12.9 | 4.2 | 13.7 | 59.6 | 9.6 | Null |
| AFS 5925.1.9.2 | 9GR22-74 | 9GR22-74-7 | 21.8 | 12.1 | 4.1 | 13.5 | 60.9 | 9.5 | Null |
| AFS 5925.1.9.2 | 9GR22-74 | 9GR22-74-13 | 21.8 | 12.5 | 3.8 | 13.0 | 60.1 | 10.7 | Null |
| AFS 5925.1.9.2 | 9GR22-74 | 9GR22-74-10 | 18.5 | 13.5 | 3.5 | 12.9 | 58.1 | 12.0 | Null |
| AFS 5925.1.9.2 | 9GR22-74 | 9GR22-74-8 | 20.7 | 13.4 | 3.6 | 12.6 | 59.6 | 10.8 | Null |
| AFS 5925.1.9.2 | 9GR22-74 | 9GR22-74-11 | 20.4 | 12.9 | 3.7 | 12.3 | 60.1 | 11.1 | Null |
| AFS 5925.1.9.2 | 9GR22-74 | 9GR22-74-4 | 20.1 | 13.0 | 4.0 | 12.1 | 58.0 | 13.0 | Null |
| AFS 5925.1.9.2 | 9GR22-74 | 9GR22-74-2 | 20.2 | 13.2 | 3.7 | 10.9 | 58.2 | 14.0 | Null |
| AFS 5925.1.9.2 | 9GR22-74 | 9GR22-74-9 | 21.2 | 12.6 | 3.7 | 10.8 | 60.0 | 12.9 | Null |
| AFS 5925.1.9.2 | 9GR22-74 | 9GR22-74-5 | 20.6 | 12.7 | 3.6 | 10.6 | 60.6 | 12.6 | Null |
| AFS 5925.1.9.2 | 9GR22-74 | 9GR22-74-15 | 20.7 | 12.5 | 3.8 | 10.2 | 59.0 | 14.5 | Null |
| AFS 5925.1.9.2 | 9GR22-74 | 9GR22-74-14 | 20.5 | 13.4 | 3.9 | 10.1 | 55.5 | 17.1 | Null |
| AFS 5925.1.9.2 | 9GR22-74 | 9GR22-74-3 | 15.8 | 13.7 | 3.6 | 10.0 | 59.6 | 13.1 | Null |
| AFS 5925.1.9.2 | 9GR22-74 | 9GR22-74-6 | 12.7 | 15.4 | 3.8 | 8.8 | 52.0 | 20.0 | Null |
| | 9GR22-74 Avg. | | 19.8 | 13.1 | 3.8 | 11.9 | 58.5 | 12.7 | |
| AFS 5925.1.9.2 | 9GR22-93 | 9GR22-93-15 | 27.0 | 10.5 | 5.3 | 37.2 | 42.2 | 4.8 | Homoz |
| AFS 5925.1.9.2 | 9GR22-93 | 9GR22-93-4 | 18.9 | 9.0 | 4.9 | 36.4 | 43.4 | 6.3 | Homoz |
| AFS 5925.1.9.2 | 9GR22-93 | 9GR22-93-14 | 27.7 | 10.5 | 5.4 | 34.2 | 44.3 | 5.6 | Homoz |
| AFS 5925.1.9.2 | 9GR22-93 | 9GR22-93-16 | 24.9 | 11.1 | 5.1 | 33.2 | 44.9 | 5.7 | Homoz |
| AFS 5925.1.9.2 | 9GR22-93 | 9GR22-93-3 | 26.5 | 10.8 | 4.8 | 32.7 | 46.2 | 5.5 | Homoz |
| AFS 5925.1.9.2 | 9GR22-93 | 9GR22-93-5 | 27.8 | 10.3 | 5.2 | 32.7 | 45.8 | 6.1 | Homoz |
| AFS 5925.1.9.2 | 9GR22-93 | 9GR22-93-12 | 26.1 | 11.4 | 4.8 | 31.1 | 46.9 | 5.8 | Homoz |
| AFS 5925.1.9.2 | 9GR22-93 | 9GR22-93-10 | 26.0 | 11.6 | 5.7 | 30.9 | 46.1 | 5.7 | Homoz |
| AFS 5925.1.9.2 | 9GR22-93 | 9GR22-93-7 | 26.0 | 12.3 | 5.9 | 30.6 | 44.4 | 6.7 | Homoz |
| AFS 5925.1.9.2 | 9GR22-93 | 9GR22-93-6 | 24.4 | 11.5 | 4.8 | 29.7 | 48.0 | 6.0 | Homoz |
| AFS 5925.1.9.2 | 9GR22-93 | 9GR22-93-9 | 25.8 | 11.3 | 6.0 | 29.5 | 47.0 | 6.3 | Homoz |
| AFS 5925.1.9.2 | 9GR22-93 | 9GR22-93-2 | 27.0 | 11.3 | 5.0 | 29.5 | 47.8 | 6.5 | Homoz |
| AFS 5925.1.9.2 | 9GR22-93 | 9GR22-93-8 | 24.8 | 11.0 | 4.4 | 29.3 | 49.6 | 5.7 | Homoz |
| AFS 5925.1.9.2 | 9GR22-93 | 9GR22-93-13 | 27.9 | 11.2 | 4.8 | 29.3 | 48.0 | 6.7 | Homoz |
| AFS 5925.1.9.2 | 9GR22-93 | 9GR22-93-1 | 24.5 | 11.8 | 4.8 | 28.6 | 49.3 | 5.4 | Homoz |
| AFS 5925.1.9.2 | 9GR22-93 | 9GR22-93-11 | 25.6 | 12.3 | 5.3 | 27.6 | 48.4 | 6.4 | Homoz |
| ARS 5925.1.9.2 | 9GR22-93 Avg. | | 25.7 | 11.1 | 5.1 | 31.4 | 46.4 | 5.9 | |
| AFS 5925.2.7.1 | 9GR22-114 | 9GR22-114-3 | 20.8 | 11.1 | 3.5 | 13.8 | 63.4 | 8.2 | Null |
| AFS 5925.2.7.1 | 9GR22-114 | 9GR22-114-12 | 20.1 | 12.4 | 4.0 | 12.5 | 60.1 | 10.9 | Null |
| AFS 5925.2.7.1 | 9GR22-114 | 9GR22-114-6 | 20.6 | 11.4 | 3.5 | 11.9 | 64.1 | 9.1 | Null |
| AFS 5925.2.7.1 | 9GR22-114 | 9GR22-114-13 | 21.0 | 12.1 | 3.7 | 11.8 | 62.8 | 9.6 | Null |
| AFS 5925.2.7.1 | 9GR22-114 | 9GR22-114-10 | 19.6 | 13.0 | 3.5 | 11.2 | 60.2 | 12.1 | Null |
| AFS 5925.2.7.1 | 9GR22-114 | 9GR22-114-2 | 20.6 | 11.5 | 3.5 | 11.0 | 61.9 | 12.0 | Null |
| AFS 5925.2.7.1 | 9GR22-114 | 9GR22-114-14 | 17.9 | 12.8 | 3.4 | 10.7 | 59.3 | 13.7 | Null |
| AFS 5925.2.7.1 | 9GR22-114 | 9GR22-114-11 | 23.2 | 10.6 | 3.4 | 10.6 | 63.2 | 12.2 | Null |
| AFS 5925.2.7.1 | 9GR22-114 | 9GR22-114-7 | 18.9 | 11.5 | 3.5 | 10.0 | 64.4 | 10.7 | Null |
| AFS 5925.2.7.1 | 9GR22-114 | 9GR22-114-1 | 19.4 | 10.7 | 3.4 | 9.9 | 65.2 | 10.7 | Null |
| AFS 5925.2.7.1 | 9GR22-114 | 9GR22-114-8 | 20.3 | 13.0 | 3.3 | 9.6 | 60.8 | 13.3 | Null |
| AFS 5925.2.7.1 | 9GR22-114 | 9GR22-114-15 | 21.7 | 11.1 | 3.3 | 9.2 | 63.0 | 13.3 | Null |
| AFS 5925.2.7.1 | 9GR22-114 | 9GR22-114-9 | 22.4 | 10.6 | 3.2 | 7.9 | 65.4 | 12.8 | Null |
| AFS 5925.2.7.1 | 9GR22-114 | 9GR22-114-5 | 19.6 | 11.9 | 3.2 | 7.1 | 58.0 | 19.8 | Null |
| AFS 5925.2.7.1 | 9GR22-114 | 9GR22-114-4 | 19.1 | 11.8 | 3.8 | 6.9 | 62.1 | 15.3 | Null |
| AFS 5925.2.7.1 | 9GR22-114 | 9GR22-114-16 | 19.7 | 10.4 | 3.4 | 6.1 | 61.2 | 19.0 | Null |

TABLE 22-continued

Oil Content and Fatty Acid Profile of T2 Soybean Seed Generated with PHP 36710

| Event | Plant | Seed | % oil | % 16:0 | % 18:0 | % 18:1 | % 18:2 | % 18:3 | Segregant Type |
|---|---|---|---|---|---|---|---|---|---|
| AFS 5925.2.7.1 | 9GR22-114 Avg. | | 20.3 | 11.6 | 3.5 | 10.0 | 62.2 | 12.7 | |
| AFS 5925.2.7.1 | 9GR22-115 | 9GR22-115-15 | 21.4 | 12.1 | 3.5 | 13.8 | 61.5 | 9.2 | Null |
| AFS 5925.2.7.1 | 9GR22-115 | 9GR22-115-7 | 21.7 | 11.5 | 3.6 | 12.2 | 63.1 | 9.6 | Null |
| AFS 5925.2.7.1 | 9GR22-115 | 9GR22-115-14 | 21.2 | 11.6 | 3.3 | 11.9 | 63.9 | 9.3 | Null |
| AFS 5925.2.7.1 | 9GR22-115 | 9GR22-115-16 | 19.9 | 11.0 | 3.8 | 11.7 | 63.3 | 10.2 | Null |
| AFS 5925.2.7.1 | 9GR22-115 | 9GR22-115-3 | 21.5 | 11.5 | 3.3 | 11.6 | 63.8 | 9.7 | Null |
| AFS 5925.2.7.1 | 9GR22-115 | 9GR22-115-13 | 21.3 | 10.7 | 4.2 | 11.4 | 63.0 | 10.7 | Null |
| AFS 5925.2.7.1 | 9GR22-115 | 9GR22-115-12 | 22.0 | 11.9 | 3.6 | 11.1 | 62.2 | 11.3 | Null |
| AFS 5925.2.7.1 | 9GR22-115 | 9GR22-115-5 | 22.1 | 11.5 | 4.5 | 11.0 | 61.7 | 11.3 | Null |
| AFS 5925.2.7.1 | 9GR22-115 | 9GR22-115-6 | 21.0 | 11.3 | 3.8 | 10.7 | 63.6 | 10.6 | Null |
| AFS 5925.2.7.1 | 9GR22-115 | 9GR22-115-1 | 20.3 | 11.1 | 3.9 | 10.5 | 63.7 | 10.9 | Null |
| AFS 5925.2.7.1 | 9GR22-115 | 9GR22-115-2 | 21.5 | 12.5 | 3.7 | 9.6 | 62.3 | 11.9 | Null |
| AFS 5925.2.7.1 | 9GR22-115 | 9GR22-115-8 | 21.0 | 12.8 | 4.0 | 9.5 | 61.9 | 11.8 | Null |
| AFS 5925.2.7.1 | 9GR22-115 | 9GR22-115-9 | 21.0 | 11.4 | 3.8 | 9.0 | 64.3 | 11.4 | Null |
| AFS 5925.2.7.1 | 9GR22-115 | 9GR22-115-10 | 21.3 | 12.5 | 3.3 | 8.8 | 63.0 | 12.4 | Null |
| AFS 5925.2.7.1 | 9GR22-115 | 9GR22-115-11 | 20.0 | 12.2 | 3.9 | 8.8 | 58.6 | 16.5 | Null |
| AFS 5925.2.7.1 | 9GR22-115 | 9GR22-115-4 | 19.7 | 11.1 | 3.3 | 7.9 | 63.3 | 14.3 | Null |
| AFS 5925.2.7.1 | 9GR22-115 Avg. | | 21.1 | 11.7 | 3.7 | 10.6 | 62.7 | 11.3 | |
| | Null Avg. | | 20.7 | 11.6 | 3.6 | 10.3 | 62.5 | 12.0 | |
| AFS 5925.2.7.1 | 9GR22-133 | 9GR22-133-6 | 24.7 | 11.6 | 6.1 | 29.8 | 47.9 | 4.7 | Homoz |
| AFS 5925.2.7.1 | 9GR22-133 | 9GR22-133-11 | 25.0 | 11.4 | 6.9 | 28.3 | 49.0 | 4.5 | Homoz |
| AFS 5925.2.7.1 | 9GR22-133 | 9GR22-133-9 | 25.0 | 11.9 | 5.6 | 27.8 | 49.7 | 5.0 | Homoz |
| AFS 5925.2.7.1 | 9GR22-133 | 9GR22-133-10 | 25.4 | 11.4 | 6.4 | 27.5 | 50.5 | 4.2 | Homoz |
| AFS 5925.2.7.1 | 9GR22-133 | 9GR22-133-3 | 24.1 | 12.0 | 6.4 | 27.3 | 49.8 | 4.5 | Homoz |
| AFS 5925.2.7.1 | 9GR22-133 | 9GR22-133-13 | 26.2 | 11.1 | 6.3 | 27.2 | 49.9 | 5.5 | Homoz |
| AFS 5925.2.7.1 | 9GR22-133 | 9GR22-133-12 | 24.9 | 11.8 | 6.4 | 27.0 | 50.2 | 4.6 | Homoz |
| AFS 5925.2.7.1 | 9GR22-133 | 9GR22-133-2 | 25.9 | 11.8 | 5.9 | 26.2 | 51.3 | 4.8 | Homoz |
| AFS 5925.2.7.1 | 9GR22-133 | 9GR22-133-16 | 26.6 | 12.7 | 6.5 | 25.6 | 50.2 | 5.0 | Homoz |
| AFS 5925.2.7.1 | 9GR22-133 | 9GR22-133-5 | 26.2 | 11.7 | 7.0 | 25.6 | 50.4 | 5.3 | Homoz |
| AFS 5925.2.7.1 | 9GR22-133 | 9GR22-133-4 | 23.7 | 12.7 | 6.3 | 25.5 | 51.1 | 4.4 | Homoz |
| AFS 5925.2.7.1 | 9GR22-133 | 9GR22-133-15 | 25.5 | 11.9 | 6.7 | 24.5 | 51.7 | 5.2 | Homoz |
| AFS 5925.2.7.1 | 9GR22-133 | 9GR22-133-1 | 25.4 | 13.0 | 6.0 | 24.4 | 50.8 | 5.8 | Homoz |
| AFS 5925.2.7.1 | 9GR22-133 | 9GR22-133-8 | 27.1 | 12.6 | 6.4 | 22.4 | 52.4 | 6.1 | Homoz |
| AFS 5925.2.7.1 | 9GR22-133 | 9GR22-133-14 | 24.1 | 13.3 | 6.2 | 21.3 | 53.2 | 6.0 | Homoz |
| AFS 5925.2.7.1 | 9GR22-133 | 9GR22-133-7 | 24.8 | 13.5 | 6.0 | 20.5 | 53.2 | 6.7 | Homoz |
| AFS 5925.2.7.1 | 9GR22-133 Avg. | | 25.3 | 12.2 | 6.3 | 25.7 | 50.7 | 5.1 | |
| Jack | 9GR22-425 | 9GR22-425-12 | 20.9 | 12.8 | 4.3 | 12.4 | 60.1 | 10.5 | N/A |
| Jack | 9GR22-425 | 9GR22-425-4 | 20.8 | 13.0 | 4.2 | 12.2 | 59.8 | 10.8 | N/A |
| | 9GR22-425 Avg. | | 24.8 | 12.4 | 6.1 | 23.2 | 52.3 | 6.0 | |

A summary of the average oil contents and fatty acid profiles from transgenic homozygous T2 seed compared to null T2 seed for events AFS 5925.1.9.2 and AFS 5925.2.7.1, is shown in Table 23. Also shown in Table 23 is the difference in average oil content and fatty acid between the transgenic homozygous seed and the null seed for each event (delta). The average % change for the transgenic homozygous seed compared to the null is also shown (% delta).

TABLE 23

| Event | T2 Seed Type | % oil | % 16:0 | % 18:0 | % 18:1 | % 18:2 | % 18:3 |
|---|---|---|---|---|---|---|---|
| AFS 5925.1.9.2 | Homoz Avg. | 25.7 | 11.1 | 5.1 | 31.4 | 46.4 | 5.9 |
| AFS 5925.1.9.2 | Null Avg. | 19.8 | 13.1 | 3.8 | 11.9 | 58.5 | 12.7 |
| | delta | 5.9 | −2.0 | 1.4 | 19.5 | −12.2 | −6.7 |
| | % delta | 29% | −15% | 37% | 164% | −21% | −53% |
| AFS 59252.7.1 | Homoz Avg. | 25.3 | 12.2 | 6.3 | 25.7 | 50.7 | 5.1 |
| AFS 59252.7.1 | Null Avg. | 20.7 | 11.6 | 3.6 | 10.3 | 62.5 | 12.0 |
| | delta | 4.6 | 0.5 | 2.7 | 15.4 | −11.8 | −6.9 |
| | % delta | 22% | 4% | 75% | 149% | −19% | −57% |

In summary applicants have demonstrated that co-expression of DGAT genes and SUT2 or SUT4 sucrose transporter genes provides an efficient method to increase the total fatty acid content of seed.

The article "a" and "an" are used herein to refer to one or more than one (i.e., to at least one) of the grammatical object of the article. By way of example, "an element" means one or more element.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (191 sequences)

SEQ ID NO: 1 - DNA, 1539 bp, Arabidopsis thaliana
atggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcattga

SEQ ID NO: 2 - protein, 512 aa, Arabidopsis thaliana
MVSHPMEKAANGASALETQTGELDQPERLRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGEIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLALTVLPSPPPDAPAFKATMGFH

SEQ ID NO: 3 - DNA, 1785 bp, Arabidopsis thaliana
atgagtgactcggtgtcgatctcggttccgtataggaatttgaggaaggaaattgaacttgagacggtcaccaagcatcgtcaaaacgaatctggttcttcgtcgttctctgaatctgcttctccttcgaatcattctgattcggctgatggtgaatctgtgtcgaagaattgtagtttagtgacgttggttcttagttgtacagttgccgctggagttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggctaa

SEQ ID NO: 4 - protein, 594 aa, Arabidopsis thaliana
MSDSVSISVPYRNLRKEIELETVTKHRQNESGSSSFSESASPSNHSDSADGESVSKNCSLVTLVLSCTVAAGVQFGWALQLSLLTPYIQTLGISHAFSSFIWLCGPITGLVVQPFVGIWSDKCTSKYGRRRPFILVGSFMISIAVIIIGFSADIGYLLGDSKEHCSTFKGTRTRAAVVFIIGFWLLDLANNTVQGPARALLADLSGPDQRNTANAVFCLWMAIGNILGFSAGASGKWQEWFPFLTSRACCAACGNLKAAFLLAVVFLTICTLVTIYFAKEIPFTSNKPTRIQDSAPLLDDLQSKGLEHSKLNNGTANGIKYERVERDTDEQFGNSENEHQDETYVDGPGSVLVNLLTSLRHLPPAMHSVLIVMALTWLSWFPFFLFDTDWMGREVYHGDPTGDSLHMELYDQGVREGALGLLLNSVVLGISSFLIEPMCQRMGARVVWALSNFTVFACMAGTAVISLMSLSDDKNGIEYIMRGNETTRTAAVIVFALLGFPLAITYSVPFSVTAEVTADSGGGQGLAIGVLNLAIVIPQMIVSLGAGPWDQLFGGGNLPAFVLASVAAFAAGVIALQRLPTLSSSFKSTGFHIG

SEQ ID NO: 5 - DNA, 1533 bp, Arabidopsis thaliana
atggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttgcgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccatga

SEQ ID NO: 6 - protein, 510 aa, Arabidopsis thaliana
MATSDQDRRHRVTRNRPPIARPSTSSSRPVVSPPRSKVSKRVLLRVASVACGIQFGWALQLSLLTPYVQELGIPHAWASVIWLCGPLSGLFVQPLVGHSSDRCTSKYGRRRPFIVAGAVAISISVMVIGHAADIGWAFGDREGKIKPRAIVAFVLGFWILDVANNMTQGPCRALLADLTENDNRRTRVANGYFSLFMAVGNVLGYATGSYNGWYKIFTFTKTVACNVECANLKSAFYIDVVFIAITTILSVSAAHEVPLASLASEAHGQTSGTDEAFLSEIFGTFRYFPGNVWIILLVTALTWIGWFPFILFDTDWMGREIYGGEPNIGTSYSAGVSMGALGLMLNSVFLGITSVLMEKLCRKWGAGFVWGISNILMAICFLGMIITSFVASHLGYIGHEQPPASIVFAAVLIFTILGIPLAITYSVPYALISIRIESLGLGQGLSLGVLNLAIVIPQVIVSVGSGPWDQLFGGGNSPALAVGAATGFIGGIVAILALPRTRIQKPIPLP

SEQ ID NO: 7 - DNA, 40 bp, artificial sequence
  AtSUC2 primer
cagcggccgcatggtcagccatccaatggagaaagctgca

SEQ ID NO: 8 - DNA, 42 bp, artificial sequence
  AtSUC2 primer
ttgcggccgctcaatgaaatcccatagtagctttgaaggcag

SEQ ID NO: 9 - DNA, 45 bp, artificial sequence
  AtSUT2 primer
atgcggccgcatgagtgactcggtgtcgatctcggttccgtatag

SEQ ID NO: 10 - DNA, 38 bp, artificial sequence
  AtSUT2 primer
atgcggccgcttagccgatgtggaaaccggtggacttg

SEQ ID NO: 11 - DNA, 40 bp, artificial sequence
  AtSUT4 primer
atgcggccgcatggctacttccgatcaagatcgccgtcac

SEQ ID NO: 12 - DNA, 42 bp, artificial sequence
  AtSUT4 primer
atgcggccgctcatgggagagggatgggcttctgaatccttg

SEQ ID NO: 13 - DNA, 5490 bp, artificial sequence
  AtSUC2 (At1g22710) clone
ttgcggccgctcaatgaaatcccatagtagctttgaaggcaggagcatccggaggcggtgaaggcaacaccgtcaacgccaatacaccacttaccgctgccgcaatcgctcctaacacaaatgctggaatgtttccaccaccgaatagttcgtcgaatggtccacctcccacagatattaccatctgagggacgacaatggctagattcagaacacctagggaaagtccttggccggcaccggaattggttgaaaatatggaagctagtgcaaaaggaatgctaaacgtaatggcttgggggataccgaggatggcgaagagagttaaagcaccagctgtgacgttaccaggtggacctgttttagcgccgccgtgatctcgtcggtgattctcagcttgtttcgtaaccacaaccgtcatggccaagcaaatggcgaggatgaagttaacaataccccaaagccttttagctcctcccaatttccgaccaatccattcaacaccaagagacatgaaaccaagaacaatagcgttaagcataagccccaaagcaccagctctgactccgtcgttgtaaagcttcttagaggctgcggttgcggttgcgtctgagtttcctccgtacacctcacggcccatccaatcagtgtcgaagagaaggaaagggaaccaagcgatccagtttagtgcagtgactataagaagcatccacatgggtctttttagttccttgaaagctccgaagatttctccgaaaaacggaacgttggaggcttttccatcggctgttggctctggcgtccatggcttctccttcacgtaacagagagatacgaaagtgactatgaggagaagcgttatggataggaaaaaacacgttttgaggtttgcgcagtagagatcgcatgactcagtcatcgtgaaaggcacaactttgtagagatttctgtaagatcccgcagcgtaacccaaaacgtttccaaccgccatgaaaaacgagaaaaacgcgtttgcggttcgcgttttcttagcgttccctgctgataaatcagccaagaaagctctgcagggtccttgtaaggtgttgttagccacgtcaagaatccaaaacccgagagcgaatatcgctatggctcgcgttttcggcggtttgtcaagctgatcgcccatgctgtgacctatatcggcagcgtaaccgataaggaaaacagcaacggtgactaaaccagctccagcgacgatgaagggacgacgacggccgaatcttgaggtgcaacggtcactgtggtaaccgacgataggctgaacaagcataccggagattggaccacagagccaaatcagagaagcccatttatgtgggattccgagtagctgcacgtaaggagtcaacagagataactgtaaagcccaaccgaactgtacaccggcggcaatggaagacaccgatatgatcttacgaagccgttccggctgatctaactcacccgtctgcgtttccaacgcagacgcaccatttgcagctttctccattggatggctgaccatgcggccgctgaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctcggatccactagtaacggccgccagtgtgctggaattcgccctt

SEQ ID NO: 14 - DNA, 5736 bp, artificial sequence
  AtSUT2 (At2g02860) clone
atgcggccgcatgagtgactcggtgtcgatctcggttccgtataggaatttgaggaaggaaattgaacttgagacggtcaccaagcatcgtcaaaacgaatctggttcttcgtcgttctctgaatctgcttctccttcgaatcattctgattcggctgatggtgaatctgtgtcgaagaattgtagtttagtgacgttggttcttagttgtacagttgccgctggagttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggctaagcggccgctaaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctcggatccactagtaacggccgccagtgtgctggaattcgccctt

SEQ ID NO: 15 - DNA, 5484 bp, artificial sequence
  AtSUT4 (At1g09960) clone
atgcggccgcatggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttgcgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccatgagcggccgcataagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctcggatccactagtaacggccgccagtgtgctggaattcgccctt

SEQ ID NO: 16 - DNA, 1554 bp, artificial sequence
  AtSUC2 with hexa-histidine tag
atggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcatcaccaccatcaccattga

SEQ ID NO: 17 - DNA, 1803 bp, artificial sequence
  AtSUT2 with hexa-histidine tag
atgagtgactcggtgtcgatctcggttccgtataggaatttgaggaaggaaattgaacttgagacggtcaccaagcatcgtcaaaacgaatctggttcttcgtcgttctctgaatctgcttctccttcgaatcattctgattcggctgatggtgaatctgtgtcgaagaattgtagtttagtgacgttggttcttagttgtacagttgccgctggagttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggccatcaccaccatcaccattaa

SEQ ID NO: 18 - DNA, 1551 bp, artificial sequence
  AtSUT4 with hexa-histidine tag
atggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttacgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccacatcaccaccatcaccattga

SEQ ID NO: 19 - DNA, 43 bp, artificial sequence
  AtSUC2HIS primer
aagcggccgcaaaaaccatggtcagccatccaatggagaaagc

SEQ ID NO: 20 - DNA, 50 bp, artificial sequence
  AtSUC2HIS primer
ttgcggccgctcaatggtgatggtggtgatgaaatcccatagtagctttg

SEQ ID NO: 21 - DNA, 48 bp, artificial sequence
  AtSUT2HIS primer
aagcggccgcaaaaaccatgagtgactcggtgtcgatctcggttccgt

SEQ ID NO: 22 - DNA, 56 bp, artificial sequence
  AtSUT2HIS primer
atgcggccgcttaatggtgatggtggtgatggccgatgtggaaaccggtggacttg

SEQ ID NO: 23 - DNA, 39 bp, artificial sequence
  AtSUT4HIS primer
aagcggccgcaaaaaccatggctacttccgatcaagatc

SEQ ID NO: 24 - DNA, 52 bp, artificial sequence
  AtSUT4HIS primer
ttgcggccgctcaatggtgatggtggtgatgtgggagagggatgggcttctg

SEQ ID NO: 25 - DNA, 5538 bp, artificial sequence
  AtSUC2HIS clone
aagcggccgcaaaaaccatggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcatcaccaccatcaccattgagcggccgcaaaagggcgaattcgcggccgctaaattcaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcagaattaaccctcactaaagggactagtcctgcaggtttaaacgaattcgccctt

SEQ ID NO: 26 - DNA, 5535 bp, artificial sequence
  AtSUT4HIS clone
aagcggccgcaaaaaccatggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttacgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccacatcaccaccatcaccattgagcggccgcaaaagggcgaattcgcggccgctaaattcaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcagaattaaccctcactaaagggactagtcctgcaggtttaaacgaattcgccctt

SEQ ID NO: 27 - DNA, 5780 bp, artificial sequence
  AtSUT2HIS clone
aagcggccgcaaaaaccatgagtgactcggtgtcgatctcggttccgtataggaatttgaggaaggaaattgaacttgagacggtcaccaagcatcgtcaaaacgaatctggttcttcgtcgttctctgaatctgcttctccttcgaatcattctgattcggctgatggtgaatctgtgtcgaagaattgtagtttagtgacgttggttcttagttgtacagttgccgctggagttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggccatcaccaccatcaccattaagcgaagggcgaattcgcggccgctaaattcaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcagaattaaccctcactaaagggactagtcctgcaggtttaaacgaattcgccctt

SEQ ID NO: 28 - DNA, 9087 bp, artificial sequence
  Yeast expression clone of AtSUC2HIS
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaaaaaccatggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcatcaccaccatcaccattgagc

SEQ ID NO: 29 - DNA, 9084 bp, artificial sequence
  yeast expression clone of AtSUT4HIS
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaaaaaccatggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttacgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccacatcaccaccatcaccattgagc

SEQ ID NO: 30 - DNA, 9351 bp, artificial sequence
  Yeast expression clone of AtSUT2HIS
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaaaaaccatgagtgactcggtgtcgatctcggttccgtataggaatttgaggaaggaaattgaacttgagacggtcaccaagcatcgtcaaaacgaatctggttcttcgtcgttctctgaatctgcttctccttcgaatcattctgattcggctgatggtgaatctgtgtcgaagaattgtagtttagtgacgttggttcttagttgtacagttgccgctggagttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggccatcaccaccatcaccattaagcgaagggcgaattcgc

SEQ ID NO: 31 - DNA, 9065 bp, artificial sequence
  yeast expression clone of AtSUC2
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcatggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcattgagc

SEQ ID NO: 32 - DNA, 9059 bp, artificial sequence
  yeast expression clone of AtSUT4
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcatggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttgcgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccatgagc

SEQ ID NO: 33 - DNA, 1809 bp, Glycine max
atgatgacggggaagtctgacttgttgtcgatccgcgttccctacaagaatctccaccacgattcctccgcccccgaactcgaactcgtcgacgtcaaccaccgcaacttgccaccatcaccgccaccgccaaatcactctccctcgccgccgaacaacaacaacatcaacgctccgttgcttcatctcgttctcagttgcaccgtcgccgccggcgtccaattcggctgggccttgcagctctctctcttgacgccctacattcagacgttgggaataggacatgcgttttcttcgtttatttggctctgtggccccattacaggtcttgtggttcaaccatgcgttggtatttggagtgataaatgtacttcaaggtttggcagaagacggccgttcattctggcaggatctcttatgatatgtctggctgtgatattaatcggattttctgctgacattggatatgtattaggtgatacacatgagcattgcagaacatttaaagggacccgaacaagggctgctcttgtatttattcttgggttctggatgctggaccttgctaacaacacagtgcaggggccagctcgagcacttttggctgatctgtctggtcctgatcaacgcaatgttgcaaatgctatattttgctcgtggatggcagttgggaacatcctaggatattcttcaggtgctagtggaaagtggaacaaatggtttcctttcttgacaactagagcttgctgtgaagcctgtggcaatcttaaagcagcatttcttgtggctgtggtgtttctgacattatgcacacttgtcaccctatattttgctgatgaggttccacttactactgcaagtcaacatcatcacttgtcagattcttctcctttactggatgaacaacaacaaaatggtgttgatttttcaaaattaaagcctttatctgttatggatgaatccaatagtaagagaactgagaatcacattgagaaagatacagagctgaagcatgggaatttcaaagctggggaagatcatgctgaaaatgtaatggatgggcctggagcggtattggtaaacttgttgacaagtttaaggcatttgccacctgccatgcattcagtcctggttgtaatggctctcacttggttgtcttggtttcccttctttctgtttgatacggattggatggggagagaagtttatcatggtgatccaaaaggggacacttctgaagtagatctttatgatcaaggagttagagaaggtgcatttggtttgctattgaattctgttgtccttggaattagctctttcttcattgaaccaatgtgtaagtggatgggtgcaaaattagtatgggcactgagcaattttatcgtctttgtttgcatggctggcactgctatcattagtcttatttcagtaagagattattctggagggatagaacacataattggagcaaatgaaggaatcaagatggcttccttggttgtgtttgttcttcttggttttcctcttgcgattacctatagtgttccctttgccgtcacagcagagttgactgctgattcaggaggtggccaaggattggctataggagttctaaatcttgcaattgttgttcctcagatgattatatcccttggttctggtccttgggatgctctctttggtggtggcaatatccctgcgtttgttttggcttccgtgtgtgctcttgccggtgctgtcattgcaactctcaaactgccagatctctctagcagttcattccagtcaacaggttttcatattggctag

SEQ ID NO: 34 - protein, 602 aa, Glycine max
MMTGKSDLLSIRVPYKNLHHDSSAPELELVDVNHRNLPPSPPPPNHSPSPPNNNNINAPLLHLVLSCTVAAGVQFGWALQLSLLTPYIQTLGIGHAFSSFIWLCGPITGLVVQPCVGIWSDKCTSRFGRRRPFILAGSLMICLAVILIGFSADIGYVLGDTHEHCRTFKGTRTRAALVFILGFWMLDLANNTVQGPARALLADLSGPDQRNVANAIFCSWMAVGNILGYSSGASGKWNKWFPFLTTRACCEACGNLKAAFLVAVVFLTLCTLVTLYFADEVPLTTASQHHHLSDSSPLLDEQQQNGVDFSKLKPLSVMDESNSKRTENHIEKDTELKHGNFKAGEDHAENVMDGPGAVLVNLLTSLRHLPPAMHSVLVVMALTWLSWFPFFLFDTDWMGREVYHGDPKGDTSEVDLYDQGVREGAFGLLLNSVVLGISSFFIEPMCKWMGAKLVWALSNFIVFVCMAGTAIISLISVRDYSGGIEHIIGANEGIKMASLVVFVLLGFPLAITYSVPFAVTAELTADSGGGQGLAIGVLNLAIVVPQMIISLGSGPWDALFGGGNIPAFVLASVCALAGAVIATLKLPDLSSSSFQSTGFHIG

SEQ ID NO: 35 - DNA, 1600 bp, Glycine max
atgacgacggggaagtctgatttggtgtcgatccgcgttccctacaagaacctccacgacgattcctccgcccccgaactcgaactcgtcgacgtccaccaccgcggcaaccaccgcaactcgccgccgccgaatcactctccctcgccgccgaacagcaacaacgctccgctgcttcatctcgttctcagttgcaccgtcgccgccggcgtccaattcggctgggccttgcagctctctctcttaacgccctacattcagacgttgggaataggacatgcgttttcttcgtttatttggctctgtggccccattacaggtcttgtggttcaaccatgcgttggtatttggagtgataaatgcacttcaaggtttggcagaagacgaccattcattctggcaggatctcttatgatatgtctggctgtgatattaatcggattttctgcagacattggatatgtattaggtgatacacacgagcattgcagaacatttaaagggacccgaacaagggctgctcttgtatttattcttgggttctggatgctggaccttgctaacaacacagtgcaggggccagctcgagcacttttggctgatctgtctggtcctgatcaacgcaatgttgcaaatgctgtattttgctcgtggatggcagttgggaacatcctaggatattcttcaggtgctagtggaaagtggaacaaaaatatgctggctttggatttgtgtatgtgttttactgttgttctttctatatttcctgctatggttttctttcttgacactagagcttgctgtgaagcctgtggcaatcttaaagcggcatttcttgtggcggtggtgttcctgacattatgcacactagtcaccctatattttgctgatgaggttccacttactactgcaagtcaacatcatcacttgtcagattcttctcctttactggatgaacaacaacaaaatggtgttgaattttcaaaattaaagccttcatctgttatggatgaatccaatagtacgcaaactgaggatcacattgagaaagatgcagagctgaaacatgggaatttcaaagctggggaagatcatgctgaaaatgtaatggatgggcctggagcagtattggtaaacttgttgacaagtttaaggcatttgccacctgctatgcattctgtcctggttgtaatggctctcacttggttgtcatggtttcccttctttctgtttgatacggattggatgggcagagaagtttatcatggtgatccaaaagggggcacttctgaagtagatctttatgatcaaggagttagagaaggtgcatttggtttgctattgaattctgttgtccttggaattagctctttcttcattgaaccaatgtgtaaatggatgggtgcaaaattagtatgggcactgagcaattttatcgtctttgtttgcatggctagcactgctatcattagtcttatttccataagagattattctggagggatagaacacgtaattggagcaaatgaagcaatcaagattgcttccttggttgtgtttgttcttcttggttttcctcttgcgattacctatagtgttc

SEQ ID NO: 36 - protein, 620 aa, Glycine max
MTTGKSDLVSIRVPYKNLHDDSSAPELELVDVHHRGNHRNSPPPNHSPSPPNSNNAPLLHLVLSCTVAAGVQFGWALQLSLLTPYIQTLGIGHAFSSFIWLCGPITGLVVQPCVGIWSDKCTSRFGRRRPFILAGSLMICLAVILIGFSADIGYVLGDTHEHCRTFKGTRTRAALVFILGFWMLDLANNTVQGPARALLADLSGPDQRNVANAVFCSWMAVGNILGYSSGASGKWNKNMLALDLCMCFTVVLSIFPAMVFFLDTRACCEACGNLKAAFLVAVVFLTLCTLVTLYFADEVPLTTASQHHHLSDSSPLLDEQQQNGVEFSKLKPSSVMDESNSTQTEDHIEKDAELKHGNFKAGEDHAENVMDGPGAVLVNLLTSLRHLPPAMHSVLVVMALTWLSWFPFFLFDTDWMGREVYHGDPKGGTSEVDLYDQGVREGAFGLLLNSVVLGISSFFIEPMCKWMGAKLVWALSNFIVFVCMASTAIISLISIRDYSGGIEHVIGANEAIKIASLVVFVLLGFPLAITYSVPFAVTAELTADSGGGQGLAIGVLNLAIVIPQMIISLGSGPWDALFGGGNIPAFVLASLCALAGGVIATLKLPDLSSSSFQSTGFHIG

SEQ ID NO: 37 - DNA, 1518 bp, Glycine max
atgccgaatcccgaggctcaccacccctcccggtcccgggcccggccctccacgtcagccgcggcccgccccccggcccgggcccgcgtctccctccgccagcttctgcgcgtggcatcagtcgcgagcggcatccagttcgggtgggccttacagctctctctgctgacgccctacgttcagcagctggggatcccccaccaatgggccagcatcatctggctctgcggcccagtctccggcctcttcgtgcagcccctcgtcggccacatgagcgaccgctgcaccagccgctacggccgccgcaggcccttcatcctcgtcggcgccgtcgccatcgtcgccgctgttctcgtcatcgcttacgccgccgacatcggctggctcctcggcgacaccgcggactaccgccctgccgccatcaccgtcttcatcgtcggcttctggatcctcgacgtcgctaacaacgtcacgcaaggtccctgccgtgccttgctcggtgatctcactagcaaggatcctcgaaggacacgtgttgcaaatgcttattactcactgtttatggccattggtaacattcttggctatgcaactggatcatatagtggttggtacaagatttttacttttgccctttcccctgcttgcacaattagttgtgcaaatctcaagtctgctttctttcttgacattgctttcattgcggtcacaacatatatcagcatcatggcagctcatgaagtgcctctaaattcaagtgaggcagcccatgctgaagcaggggcaggggagtcaggtagtgcagaagaagctttcatgtgggaattatttgggacattcaaatattttacaacccctgtatggataattctgtctgttactgctctgacatggattgggtggttcccatttactctctttgatactgattggatgggtcgagagatttatggtggtgatccaaatcaaggccttgtttatgatactggagttagaatgggagcacttggtttgttgcttaattcagttgttcttgcattaacatcattgttcatggagaggctatgcaggaagaggggagctggttttgtgtggggaatctcaaatatcatgatgaccgtttgctttcttgcaatgctagtagtaacctatgtggcaaataacatgggctatataggcaaagatttaccaccaactggcattgtgatagctgcgttgattatctttaccattcttgggtttccactggcaatcacttatagtgttccatatgccttaatttccacacatattgagtcattgggactcggccaagggttatcaatgggtgtcctaaatctggcaatagtggtcccacagataatagtgtcactgggaagtggaccatgggatcagctatttggtggaggaaactccccagcctttgctgtggcagctgtttcagcccttatcagtggactcatagctgtgttggctattcctcgatctggtgctcaaaaggctcgaagccatgtatga

SEQ ID NO: 38 - protein, 505 aa, Glycine max
MPNPEAHHPSRSRARPSTSAAARPPARARVSLRQLLRVASVASGIQFGWALQLSLLTPYVQQLGIPHQWASIIWLCGPVSGLFVQPLVGHMSDRCTSRYGRRRPFILVGAVAIVAAVLVIAYAADIGWLLGDTADYRPAAITVFIVGFWILDVANNVTQGPCRALLGDLTSKDPRRTRVANAYYSLFMAIGNILGYATGSYSGWYKIFTFALSPACTISCANLKSAFFLDIAFIAVTTYISIMAAHEVPLNSSEAAHAEAGAGESGSAEEAFMWELFGTFKYFTTPVWIILSVTALTWIGWFPFTLFDTDWMGREIYGGDPNQGLVYDTGVRMGALGLLLNSVVLALTSLFMERLCRKRGAGFVWGISNIMMTVCFLAMLVVTYVANNMGYIGKDLPPTGIVIAALIIFTILGFPLAITYSVPYALISTHIESLGLGQGLSMGVLNLAIVVPQIIVSLGSGPWDQLFGGGNSPAFAVAAVSALISGLIAVLAIPRSGAQKARSHV

SEQ ID NO: 39 - DNA, 1542 bp, Glycine max
atggcgaatcacgaaacccaacaacaacaacaacaacatcaacgcccccgccaacaccgccggtccaagggtcgacatgcagcggctcgaccggcggccccggctagggttccgctgaggatgctgctgcgggtagcgtcggttgccggtggcattcagttcgggtgggccctgcagctatctcttctcacgccgtacgtgcagcagctcgggatcccgcacgtgtgggccagcatcatatggctctgtgggccgctctctgggctcctggtccagcccctggtgggccacttgagcgaccgctgcactagccgctttggccgccgaagaccgtttatattgggcggagcattgtcgatcgtcgccgctgttctcatcatcggtcactccgctgacatcgggtggtggttcggcgacacccttgagcatcgcccctgggctgtcggagttttcgttttcgggttttggattttggacgtggctaacaacgtcactcagggcccttgtagagctttgcttggtgatctcactggcaaggatcaaagaaggacacgtgttgcaaatgcttattactccctgtttatggctattggtaatattcttggatatgcaactggatcatacagtggttggtacaaggtttttgctttcacacttacccctgcatgcaatattagttgtgcaaatctcaagtctgctttctttctcgacattattttcattgctgtcaccacatatataagcattgtggcagctaaagaagtgcctctaagttcaagtggagcacaccctgttgaagaagcagcagcaggggaatcaggtactgcaggagaagctttcctgtgggagctatttgggacattcagatatttttcgacccctgtatggacaatactgactgttactgctctaacatggattgggtggtttccatttctcctatttgatactgattggatgggccgagagatttatggtggtgagccaaatgaaggccctaattatgatactggagttagaatgggggcacttggcttactgcttaattcagttgttcttggagtaacgtcagtactcttggagaggctatgcaggaagcggggacctgggtttctgtggggaatttcaaatatcctaatggctgtctgctttatttcaatgcttgttgtaacctatgtggcaaataacattggctatgtaggcaaagatctaccaccaactggcattgtgatagcttcattgataatctttaccattcttggatttccacttgcaatcacttacagcgttccatatgccttgatttccacacacattcagtcattggggcttggccaaggattgtcaatgggagtcctaaatcttgcaattgtgttcccacagatggtggtttccctgggaagtggaccatgggatcagctatttggtgggggaaactctccagcctttggtgtggcagctgttgcagcccttgccagtggactcatagctgtcttgtttattccccgtcctggtggtcaaaagcctcgaagccctgtatga

SEQ ID NO: 40 - protein, 513 aa, Glycine max
MANHETQQQQQQHQRPRQHRRSKGRHAAARPAAPARVPLRMLLRVASVAGGIQFGWALQLSLLTPYVQQLGIPHVWASIIWLCGPLSGLLVQPLVGHLSDRCTSRFGRRRPFILGGALSIVAAVLIIGHSADIGWWFGDTLEHRPWAVGVFVFGFWILDVANNVTQGPCRALLGDLTGKDQRRTRVANAYYSLFMAIGNILGYATGSYSGWYKVFAFTLTPACNISCANLKSAFFLDIIFIAVTTYISIVAAKEVPLSSSGAHPVEEAAAGESGTAGEAFLWELFGTFRYFSTPVWTILTVTALTWIGWFPFLLFDTDWMGREIYGGEPNEGPNYDTGVRMGALGLLLNSVVLGVTSVLLERLCRKRGPGFLWGISNILMAVCFISMLVVTYVANNIGYVGKDLPPTGIVIASLIIFTILGFPLAITYSVPYALISTHIQSLGLGQGLSMGVLNLAIVFPQMVVSLGSGPWDQLFGGGNSPAFGVAAVAALASGLIAVLFIPRPGGQKPRSPV

SEQ ID NO: 41 - protein, 607 aa, Citrus sinensis
MSETRSFKVPYRNLKKGTAAEVEMIEADEFHHRIDLNSNASSPPSSSHSPIPNGTSNFAVRPKQCSLITLVLSCTVAAGVQFGWALQLSLLTPYIQTLGIQHAFSSFIWLCGPITGLVVQPCVGIWSDKCTSKYGRRRPFILAGCLMISVAVIIIGFSADIGYILGDTKEHCSKFRGTRTRAAFVFVIGFWLLDLANNTVQGPARALLADLSGPDQRNSANAILCSWMAVGNILGFSAGASGSWHRWFPFLTSRACCAACGNLKAAFLVAVVFLTLCALVTIYFADEVPLTVNQPNHLTDSAPLLDDPQRTAISKSKHDMPAAPNANGNKVESGHERDANLKHISKKAEDPNGSFNDGPGAVLVNLLTSLRHLPPAMHVVLVVMALTWLSWFPFFLFDTDWMGREVYHGDPKGNDHEVKFYDQGVREGAFGLLLNSVVLGVSSFLIEPMCRWIGSRLVWAISNFIVFACMATTAIISVISVRRNILEGIEHGIGANQAIKVASLVVFTLLGFPLAITYSVPFAITGELTADSGGGQGLAIGVLNLAIVIPQMIVSLGAGPWDALFGGGNIPAFGLASLSALAGGVVATLKLPHLSSNSFTSSGFHFG

SEQ ID NO: 42 - protein, 604 aa, Eucommia ulmoides
MDAVTIRVPYRNLKQEVELVGIEEQPPRRVQIDQSSSGNSNGNVSNHSPNSSPSDLAPKQNTLFSLILCCTVAAGVQFGWALQLSLLTPYIQTLGIGHAFSSFIWLCGPITGLVVQPCVGIWSDKCTSKYGRRRPFILVGSLMISIAVIVIGFSADIGYLIGDTEEHCRTFKGTRTRAAFVFIVGFWMLDLANNTVQGPARALLADLAGPDQRNSANAVFCSWMAVGNILGFSAGASGQWHRWFPFLMSRACCEACGNLKAAFLVAVVFLTFCTLVTLHFAKEVPLTTPKQPQRLSDSAPLLGNPRQLSFDFSKQKTEMPLVNSETENKSESDSKTESNGKTEDQKVEKDQFESFNDKPGAVLVNLLTSLRHLPPAMHSVLLVMALTWVSWFPFFLFDTDWMGREVYHGDPKGDAAEVRAYDQGVREGAFGLLLNSVVLGVSSFLIEPMCQRLGSRLVWAMSNFIVFACMAGTAVISLVSDIEFGNEHVVGGKETIKTASLVVFAILGLPLAITYSVPFSVTAELTADAGGGQGLAIGVLNLAIVVPQMIVSLGAGPWDALFGGGNIPAFVLASLSALAAGVIATLKLPDLANSSYSSTGFHFG

SEQ ID NO: 43 - protein, 605 aa, Solanum tuberosum
MDAVSIRVPYKNLKQQEVELTNVDESRFTQLEIRSDSSSPRASNGEMNDSHLPLPPPPVRNSLLTLILSCTVAAGVQFGWALQLSLLTPYIQTLGIEHAFSSFIWLCGPITGLVVQPCVGIWSDKCHSKYGRRRPFIFIGAVMISIAVIIIGFSAADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVFLTLCTLVTLYFANEVPLSPKQYKRLSDSAPLLDSPQNTGFDLSQSKRELQSVNSVANNESEMGRVADNSPKNEEQRPDKDQGDSFADSPGAVLVNLLTSLRHLPPAMHSVLIVMALTWLPWFPFFLFDTDWMGREVYHGDPKGEADEVNAYNQGVREGAFGLLLNSVVLGVSSFLIEPMCKWIGSRLVWAVSNFIVFVCMACTAIISVVSISAHTEGVQHVIGATKSTQIAALVVFSLLGIPLAVTYSVPFSITAELTADAGGGQGLAIGVLNLAIVLPQMVVSLGAGPWDALFGGGNIPAFVLASLAALAAGIFAMLRLPNLSSNFKSTGFHFG

SEQ ID NO: 44 - protein, 604 aa, Lycopersicon esculentum
MDAVSIRVPYKNLKQQEVELTNVDESRFAQLEIRSDSSSPRVSNGEMNDSNLPLPPPPVRNSLLTLILSCTVAAGVQFGWALQLSLLTPYIQTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVFLTLCTLVTLYFANEVPLSPKQYKRMSDSAPLLDSPQNTGFDLSQSKRELQYRNSVANNESEMGHVADNSPKNEEQRPDKDQGDSFADSPGAVLVNLLTSLRHLPPAMHSVLIVMALTWLSWFPFFLFDTDWMGREVYHGDPKGEADEVNAYNQGVREGAFGLLLNSVVLGVSSFLIEPMCKWIGSRLVWAVSNFIVFVCMACTAIISVVSISANTQGVQHVIGATRSTQIAALVVFSLLGIPLAVTYSVPFSITAELTADAGGGQGLAIGVLNLAIVVPQMVVSLGAGPWDALFGGGNIPAFALASLAALAAGIFAMLRLPNLSSNFKSTGFHFG

SEQ ID NO: 45 - protein, 595 aa, Oryza sativa
MDSAAGGGGLTAIRLPYRHLRDAEMELVSLNGGTPRGGSPKDPDATHQQGPPAARTTTTRKLVLACMVAAGVQFGWALQLSLLTPYIQTLGIDHAMASFIWLCGPITGFVVQPCVGVWSDKCRSKYGRRRPFILAGCLMICFAVTLIGFSADLGYILGDTTEHCSTYKGSRFRAAIIFVLGFWMLDLANNTVQGPARALLADLSGPDQCNSANAIFCTWMAVGNVLGFSSGASGNWHKWFPFLMTRACCEACSNLKAAFLVAVVFLLFCMSVTLYFAEEIPLEPTDAQRLSDSAPLLNGSRDDNNASNEPRNGALPNGHTDGSNVPANSNAEDSNSNRENVEVFNDGPGAVLVNILTSMRHLPPGMYSVLLVMALTWLSWFPFFLFDTDWMGREVYHGDPNGNLSERKAYDNGVREGAFGLLLNSVVLGIGSFLVDPLCRLMGARLVWAISNFTVFICMLATAILSWISFDLYSSKLHHIIGANKTVKNSALIVFSLLGLPLSITYSVPFSVTAELTAGTGGGQGLATGVLNLAIVVPQIVVSLGAGPWDALFGGGNVPAFALASVFSLGAGVLAVLKLPKLPNSYRSAGFHGFG

SEQ ID NO: 46 - protein, 592 aa, Zea mays
MDAGAGATAIRVPYRHLRDAEMELVSLNGGAPGGDTGPPPPPPKDQPRSRADRTKLVLACMVAAGVQFGWALQLSLLTPYIQTLGIDHAMASFIWLCGPITGFVVQPCVGVWSDKCRSKYGRRRPFILAGCIMICAAVTLIGFSADLGYILGDTTEHCRTYKGSRFRAAIVFILGFWMLDLANNTVQGPARALLADLSGPDQCNSANAIFCSWMAVGNILGFSAGASGEWHKWFPFLTTRACCEACGNLKAAFLVAVVFLLLCMSVTLYFAEESPLDPKDTQGLSDSAPLLNGSRDAAHASNEPNNERFPNGHVGLNNVSANNNTEEFTNVNSNTEKGGVFNDGPGAVLVNILTRMRHLPPGMHSVLLVMALTWLSWFPFFLFDTDWMGREVYHGDPNGDLSERKAYDNGVREGAFGLLLNSVVLGVGSFLVDPLCRMIGARLVWAISNFTVFICMMATTILSWISSDLYSSKLHHIIGANKTVKITALVVFSLLGLPLSITYSVPFSVTAELTAGTGGGQGLATGVLNLAIVVPQIVVSLGAGPWDALYGGGNTPAFVLASVFSLAAGVLAVLKLPKLSNSYQSAGFHGFG

SEQ ID NO: 47 - protein, 594 aa, Sorghum bicolor
MDAGTGGGGPTAIRVPYRHLRDAEMELVSLNGADAGPTPHKDADQPRSRGANADRTKLVLACMVAAGVQFGWALQLSLLTPYIQTLGIDHAMASFIWLCGPITGFVVQPCVGVWSDKCRSKYGRRRPFILAGCIMICAAVTLIGFSADLGYILGDTTEHCRTYKGSRFRAAMVFILGFWMLDLANNTVQGPARALLADLSGPDQCNSANAIFCSWMAVGNILGFSAGASGDWHKWFPFLMTRACCEACGNLKAAFLVAVVFLLFCMSVTLYFAEEIPLEPKDAQGLSDSAPLLNGSREDAHALNEPNNERFPNGHVDGNNVSANNNTEEFPNANSNTDNGGVFNDGPGAVLVNILTSMRHLPPGMHSVLVVMALTWLSWFPFFLFDTDWMGREVYHGDPNGDLSERKAYDNGVREGAFGLLLNSVVLGVGSFLVDPLCRMIGARLVWAISNFTVFICMMATTILSWISSDLYSSKLHHIIGANKTVKTTALVVFSLLGLPLSITYSVPFSVTAELTAGTGGGQGLATGVLNLAIVVPQIVVSLGAGPWDALYGGGNIPAFALASVFSLAAGVLAVLKLPKLSNSYQSAGFHGFG

SEQ ID NO: 48 - protein, 599 aa, Plantago major
MMDAVSIRVPYKNLKQEVELVSADDDSHQRHRVQIQSSPEPLESPDSDRHHTPQKNCSLMTLILSCTIAAGVQFGWALQLSLLTPYIQTLGVEHAFSSFIWLCGPITGLVVQPCVGIWSDKCTSKYGRRRPFILIGSLMIAVSVIIIGYSADIGYVLGDTKEHCSTFKGTRTRAAIVFIIGFWMLDLANNTVQGPARALLADLSGPEQRNAANAIFCSWMAVGNILGFSSGASGNWHRWFPFLTSRACCEPCGNLKAAFLVAVVFLALCTLVTLYFAKEVPLTPKHPHHLSDSAPLLNEPQQNGSELSKLEIDTEFRHVPLEVKPDGHGMDNDIVGRKISEDDNTSLTDSPGAVLVNLLTSLRHLPPAMHSVLVVMALTWLSWFPFFLFDTDWMGREVYNGDPKGETAAKVQAYNQGVREGAFGLLLNSVVLGISSFLIEPMCKRMGARLVWASSNFIVFVCMAGTAIISFVSLRQMSDGVQDVIGANETTKIASLVIFTLLGFPLAVTYSVPFSVTAELTADSGGGQGLAIGVLNLAIVVPQMIVSLGAGPWDALFGGGNVPAFALASVASLAAGVIAVHKLPVLSSDSFKSTGFHFG

SEQ ID NO: 49 - protein, 608 aa, Manihot esculenta
MDTVSLRVPYRNLKKDVEVEMVGVEEQHHYPIQLDNSPSSSASSLNYTSQIPNSDSSFSVRSKATKHYSLITLILSCTVAAGVQFGWALQLSLLTPYIQTLGIEHAFSSFIWLCGPITGLVVQPCVGIWSDKCTSKFGRRRPFILAGSLMISVSVIIIGFSADIGYILGDTKEHCSTFKGTRTRAAFVFVIGFWLLDLANNTVQGPARALLADLSGPDQRNCANAVFCSWMAVGNILGFSAGASGSWNRWFPFLMSRACCEACGNLKAAFLVAVVFLTLCTLVTLYFAREVPLITSESHRLSDSAPLLDDTQQNGLELSKSKSDNSNGNINKGIEQNVNPKHGIANANSIEDQNEGLGDGPGAVLVNLLTSLRHLPPGMHSVLVVMALTWLSWFPFFLFDTDWMGREVYHGDPKGNSDEAKFYDQGVREGAFGLLLNSVVLGISSFLIEPLCQRMGPRLVWAMSNYIVFASMAVTAIISLISISNILEVIEHVIGASASITIAALIVFALLGFPLAITYSVPFSVTSELTADSGGGLGLAIGLLNLAIVVPQMIISLGAGPWDALFGGGNIPAFALASVCALAAGIIAALKLPNLSSSSFQSSGFHFG

SEQ ID NO: 50 - protein, 611 aa, Hevea brasiliensis
MDSLSIRVPYRNLKKEVEVEMVGVEEQNHHSIQLDNSSPSSASSPNSASQIPNGDSGFPVRSKTAKHYSLITLILSCTVAAGVQFGWALQLSLLTPYIQTLGIEHAFSSFIWLCGPITGLVVQPCVGIWSDKSTSKFGRRRPFILAGSVMISVAVIIIGFSADIGYILGDTKEHCSTFKGTRTRAAFVFVIGFWLLDLANNTVQGPARALLADLSGPDQRNSANAVFCSWMAVGNILGFSAGASGSWNRWFPFLMSRACCEACGNLKAAFLVAVVFLTLCTLVTLYFAKEVPLITNQSHRLSDSAPLLDDPQQNGLELSKSKSEVSILSNSNGDINKGIEQNVNPKPGIANSIEDQNESLGDGPGAVLVNLLTSLRHLPPGMHSVLVVMALTWLSWFPFFLFDTDWMGREVYHGDPKGNSDEVKLYDQGVREGAFGLLLNSVVLGISSFLIEPMCQRMGPRLVWAMSNFIVFASMAVTAIISLISIGEYSGGIEHVIGASLSIRIAALIVFAFLGFPLAITYSVSFSVTAELTADSGGGQGLAIGVLNLAIVIPQMVISLGAGPWDALFGGGNIPAFALASVCALAAGVIATLKLPNLSSSSFKSSGFHFG

SEQ ID NO: 51 - DNA, 1879 bp, Paspalum notatum
  misc_feature (924)..(924): n is a, c, g, or t
tgcatggtcgccgcaggcgtgcagttcggatgggcgctgcagctctctctcctcaccccatacatccagaccctaggaatagaccatgccatggcatcatttatttggctctgtgggcctataactggttttgtggttcaaccctgtgtcggagtgtggagtgataaatgccgctccaagtacgggaggagacgcccatttattttggctggatgcctgatgatatgtgctgctgtaacgttaatcgggttttctgcagacctcggttacatcttaggagataccactgagcactgcagaacatataaaggttatagataccgagctgctatggttttcattcttggattctggatgttggaccttgcgaacaatacagtgcaaggtcctgcccgtgcccttctagccgatctttcaggtcctgatcagtgtaattccgcaaatgcgatattctgctcatggatggctgttggaaatattcttggtttctcagctggtgcgagcgggaattggcacaaatggtttccttttctaacgacaagagcctgctgtgaagcttgtggtaatttgaaagcagctttcttagttgcagttgtatttctgttgttttgtatgtctgttaccctgtactttgctgaagagatcccactagaaccaaaggatgcacaaggactatctgattctgcccctctgctgaacggttctagagatgatgaccatgcatcgaatgaaacaaataatgaaaggtttcctaatggccgtgtggatggaaacaatgtctcggctaactctagcactgaggattctacgaatgtgaattccaactcgaacagagacactggagaagttttcaatgatggaccaggagcagttttggttaacattttgaccagcatgaggcatctgcctcctggaatgcattcngtgcttgtagttatggccctaacatggttgtcatggtttccttttttcctttttgacactgactggatggggcgtgaagtttaccatggggatccaaatggagatccgactgagaggagagcttatgacaatggtgtccgagaaggtgcatttggtttgctattgaattcggttgtccttggcattggttccttccttgttgatccactatgccggctgattggtgcaagattggtttgggccattagcaacttcacagtgtttgtctgcatgatggctacaacaatactgagttggatctcttctgatctgtactcaagtaaactccatcatatcattggagcaaataaaacagtcaagaatgcagcattgattgttttctctcttctcggattgccactctccatcacctatagtgttccattttctgtgactgctgagctgactgctggtacaggaggtggacaaggtttggctacaggagttctaaatcttgctattgtcgttccccagatagtagtctcactgggagcaggtccatgggacgctctgtatgggggaggaaacatcccagcgttcgccttggcttcgatcttctccttggcggctggtgtgctcgccgttctcaagctaccaaagctgtctaactcgtaccaatctgccggtttccatggatttggttaaatgctggcgcccaaagccttctgccacgtagcatccggacacaccaccaacaccgagccccgttttcccattcgtttacagtgaaatgattctttttcctcctaccactacagaagagcatcggcagtagacattaggatacagaggctagttaggttgatgtgcatacaagccaaatgcaaaggtctttttttctggcagtaatatgtaacagctgcccctgcccatatggcggggaaattttacaagtggtgtaggagtaacacgtttt

SEQ ID NO: 52 - protein, 535 aa, Paspalum notatum
CMVAAGVQFGWALQLSLLTPYIQTLGIDHAMASFIWLCGPITGFVVQPCVGVWSDKCRSKYGRRRPFILAGCLMICAAVTLIGFSADLGYILGDTTEHCRTYKGYRYRAAMVFILGFWMLDLANNTVQGPARALLADLSGPDQCNSANAIFCSWMAVGNILGFSAGASGNWHKWFPFLTTRACCEACGNLKAAFLVAVVFLLFCMSVTLYFAEEIPLEPKDAQGLSDSAPLLNGSRDDDHASNETNNERFPNGRVDGNNVSANSSTEDSTNVNSNSNRDTGEVFNDGPGAVLVNILTSMRHLPPGMHSVLVVMALTWLSWFPFFLFDTDWMGREVYHGDPNGDPTERRAYDNGVREGAFGLLLNSVVLGIGSFLVDPLCRLIGARLVWAISNFTVFVCMMATTILSWISSDLYSSKLHHIIGANKTVKNAALIVFSLLGLPLSITYSVPFSVTAELTAGTGGGQGLATGVLNLAIVVPQIVVSLGAGPWDALYGGGNIPAFALASIFSLAAGVLAVLKLPKLSNSYQSAGFHGFG

SEQ ID NO: 53 - protein, 521 aa, Zea mays
MARGDGELELSVGVRGTGGAAAAAAADHVAPISLGRLILAGMVAGGVQYGWALQLSLLTPYVQTLGLSHALTSFMWLCGPIAGLVVQPLVGLYSDRCTARWGRRRPFILIGCMLICLAVIVVGFSSDIGAALGDTKEHCSLYHGPRWHAAIVYVLGFWLLDFSNNTVQGPARAMMADLCGHHGPSAANSIFCSWMALGNILGYSSGSTNNWHKWFPFLLTNACCEACANLKGAFLVAVVFLVMCLTVTLFFANEVPYRGNQNLPTKANGEVETEPSGPLAVLKGFKNLPTGMPSVLLVTGLTWLSWFPFILYDTDWMGREIYHGDPKGSNAQISAFDEGVRVGSFGLLLNSIVLGFSSFLIEPMCRKVGPRVVWVTSNFMVCVAMAATALISFWSLKDYHGYVQDAITASTSIKAVCLVLFAFLGVPLAILYSVPFAVTAQLAATKGGGQGLCTGVLNISIVIPQVIIALGAGPWDALFGKGNIPAFGVASGFALIGGVVGVFLLPKISKRQFRAVSAGGH

SEQ ID NO: 54 - protein, 519 aa, Sorghum bicolor
MARGDGELELSVGVRGAGGGAAAADHVAPISLGRLILAGMVAGGVQYGWALQLSLLTPYVQTLGLSHALTSFMWLCGPIAGLVVQPLVGLYSDRCTARWGRRRPFILTGCVLICIAVIVVGFSSDIGAALGDTKEHCSLYHGPRWHAAIVYVLGFWLLDFSNNTVQGPARAMMADLCGHHGPSAANSIFCSWMALGNILGYSSGSTNNWHKWFPFLKTNACCEACANLKGAFLVAVVFLVICLAITLVFAKEVPYRGNENLPTKANGEVEAEPTGPLAVLKGFKNLPRGMPSVLLVTGLTWLSWFPFILYDTDWMGREIYHGDPKGTNAQISAFNEGVRIGAFGLLLNSIVLGFSSFLIEPMCRKVGPRVVWVTSNFMVCIAMAATALISFWSLKDYHGYVQNAITASTSIKAVCLVLFAFLGVPLAILYSVPFAVTAQLAASMGGGQGLCTGVLNISIVIPQVIIAVGAGPWDALFGKGNIPAFGVASGFALIGGVVGMFLLPRISKRQFRAVSAGGH

SEQ ID NO: 55 - protein, 519 aa, Zea mays
MARGDGGQLAELSAGVRGAAAVVDHVAPISLGRLILAGMVAGGVQYGWALQLSLLTPYVQTLGLSHALTSFMWLCGPIAGLVVQPLVGLYSDRCTSRWGRRRPFILTGCMLICVAVIVVGFSSDIGAALGDTKEHCSLYHGPRWHAAIVYVLGFWLLDFSNNTVQGPARAMMADLCDHHGPSAANSIFCSWMALGNILGYSSGSTNNWHKWFPFLKTSACCEACANLKGAFLVAVVFLVLCLTVTLIFAKEVPYRANENLPTTKAGGEVETEPTGPLAVLKGFKDLPPGMPSVLLVTAITWLSWFPFILYDTDWMGREIYHGDPKGSNAQISAFNEGVRVGAFGLLLNSVILGFSSFLIEPMCRKVGPRVVWVTSNFMVCVAMAATALISFWSLRDYHGYVQDAITANASIKAVCLVLFAFLGVPLAILYSVPFAVTAQLAATRGGGQGLCTGVLNISIVIPQVIIALGAGPWDALFGKGNIPAFGVASAFALVGGVVGVFLLPKISKRQFRAVSAGGH

SEQ ID NO: 56 - protein, 522 aa, Triticum aestivum
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAANRGGGQGLCTGVLNIAIVIPQVIIAVGAGPWDELFGKGNIPAFGVASAFALIGGIVGIFLLPKISRRQFRAVSGGGH

SEQ ID NO: 57 - protein, 522 aa, Triticum aestivum
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGYILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDMHGYIQHAITASKEIKIVSLALFAFLGVPLAILYSVPFAVTAQLAANRGGGQGLCTGVLNIAIVIPQVIIAVGAGPWDELFGKGNIPAFGMASAFALIGGIVGIFLLPKISRRQFRAVSGGGH

SEQ ID NO: 58 - protein, 523 aa, Sorghum bicolor
MARGGGNGEVELSVGVGGGGGGAAGGGEQPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAAKRGGGQGLCTGVLNIAIVIPQVIIAVGAGPWDELFGKGNIPAFGMASAFALIGGIVGIFLLPKISRRQFRAVSGGGH

SEQ ID NO: 59 - protein, 523 aa, Hordeum vulgare
MARGGGNGEVELSVGVGGGGGGAAPRAAEPAVQISLGRLILAGMVAGGVQYGWALQLSLLTPYVQTLGLSHALTSFMWLCGPIAGLVVQPCVGLYSDKCTSRWGRRRPFILTGCVLICLAVIIVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLSLALVITLIFAKEVPYKAIAPLPTKANGQVEVEPTGPLAVFKGFKNLPPGMPSVLLVTGLTWLSWFPFILYDTDWMGREIYHGDPKGTPAEANAFQEGVRAGAFGLLLNSVVLGFSSFLIEPMCKRLGPRVVWVSSNMLVCLSMAAICIISWWATQDLHGYIQHAITASKEIKAVSLALFAFLGIPLAILYSVPFAVTAQLAANKGGGQGLCTGVLNIAIVIPQVIIAVGAGPWDELFGKGNIPAFGMASVFALIGGVVGIFLLPKISRRQFRAVSGGGH

SEQ ID NO: 60 - protein, 538 aa, Oryza sativa
MARGSGAGGGGGGGGGGLELSVGVGGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSVSMGGGH

SEQ ID NO: 61 - protein, 506 aa, Oryza sativa
MAVDMELDGGGDGKGKAPPQISLSGLFLACMVAGGVQYGWALQLSLLTPYVQTLGIPHALTSVMWLCGPIAGLIVQPCVGLYSDKCTSSLGRRRPFILTGCIIICISVIVIGFSSDIGYALGDTTEDCKVYRGPRYHAAAAFILGFWLLDFSNNTVQGPARALMADLSGRHGPSAANAIFCSWMALGNILGYSSGSTNDWHKWFPFLMTRACCEACANLKAAFLVAVVFLGLSTAVTMVFAREVALDPVAAAKRNEGEASGLLAVFKGMKNLPVGMPSVLIVTGLTWLSWFPFILFDTDWMGREIYHGRPDGSPAEVTAFQEGVRQGAFGLLLNSIVLGISSFLIEPMCRRLGARAVWVMSSAVVCVAMAAVSVLSAWSLGDFGGSVQDAARAPAEEGGVRASALALFVFLGLPFAVLCSVPFAVTAQLAASRGGGQGLCTGVLNISIVVPQMAIALGAGPWDELFGEGNIPAFAMASVFAAAAAAAGVVLLPKVSVRSVSMAGGH

SEQ ID NO: 62 - protein, 507 aa, Sorghum bicolor
MAADGTEVSAGGDGGGNKQPQISIVGLFLACMVAGGVQYGWALQLSLLTPYVQTLGIPHALTSVMWLCGPIAGLLVQPCVGLYSDKCTSKLGRRRPFIFTGCIVICISVIVIGFSSDIGYALGDTTEDCKVYTGKRLHAALFFVMGFWLLDFSNNTVQGPARALMADLAGSHGPSTANAIFVSWMAIGNILGYSSGSTDKWHTWFPFLQTKACCEACANLKAAFLVSVAFLGLSTVVTMIFATEEPLDPAAAKQGEDGEPSGPFAVFKGMKNLPPGMPQVLIVTGLTWLSWFPFILFDTDWMGREMYHGKPDGSPTEVANYQEGVRQGAFGLLLNSIVLGVSSFLIEPMCRKLTAKVVWVISSFLVCVAMAMVTVLSSWALGDIGGNVQDAAAVDKGLKGTALAIFVFLGFPFAVLCSVPFAVTAQLAATKGGGQGLCTGVLNISIVLPQMIIAVGSGPWDELFGKGNIPAFGAAAGFAFTAAVAGIIMLPKQPKTSFRSVSMGGGH

SEQ ID NO: 63 - protein, 508 aa, Zea mays
MAGDGMEVSASGGGGGNKQPQISLLGLFLACMVAGGVQYGWALQLSLLTPYVQTLGIPHALTSVMWLCGPIAGLLVQPCVGLYSDKCTSKLGRRRPFIFTGCIIICISVIVIGFSSDIGYALGDTTEDCNVYTGKRLHAALFFVMGFWLLDFSNNTVQGPARALMADLAGSHGPSTANAIFVSWMAIGNILGYSSGSTDKWHTWFPFLQTRACCEACANLKAAFLVSVVFLGLSTVVTMIFAREVPLDPAAAAKQDEAGESSGPFAVFKGMKNMPPGMPQVLIVTGLTWLSWFPFILFDTDWMGREMYHGRPDGSPEEVARFQEGVRQGAFGLLLNSVVLGASSFLIEPMCRKLTAKVVWVMSSFLVCVAMALVTVLSSWSLGDIGGNVQDAAAVDKGLKTTALAIFVFLGFPFAVLCSVPFAVTAQLAAAKGGGQGLCTGVLNISIVVPQMVIAIGSGPWDELFGKGNIPAFGLAAVFAFTAAVAGIIMLPKQPKTSFRSVSMGGGH

SEQ ID NO: 64 - protein, 535 aa, Oryza sativa
MEEGRRGDREGKSAAGWTALSTTKTTLEEKRRLQANGSVGGDAGTSGFRRIVRLFFACMVAGGIQYGWALQLSLLSPYSQTLGISHSYVSLTWICGPIAGFVVQPIVGYYSDRCTMKMGRRRPFILVGCLIICISVMIIGFSADIGRHLGDTKEHCSTYTGPRWSAAMVYIVGFWFLDFANNTVQGPARAMMADLSAGHHGPNVGQSIFSLWMAIGSVLGYLSGANGKWHEWFPWLKTAACCDACANLKGAFFTAVLLIVVSMTVTMYLADEMPLDKQDVDTSGGGGCAVFVDLFKSLRNLPPAMFKVLAVTAVTWLSWFPFIQYNTDWMGREIYHGEPQGTAAKADVYDAGVREGAMGLLFCSVALGVTSFVIPKLCRRLTSKVVWSISNFLVFALMAVMVAVGMVSMRGYRPSLAAGLTGPDPTLKAVALVVFALIGIPQAVLFSVPWAVASEVTAEEGGGQGLAIGVLNIAIVVPQLVIALTAGPIDGAFNKGNTPAFGIGGAFAFICGVLALIWLPKTRGVSNAAVVAGGH

SEQ ID NO: 65 - protein, 534 aa, Sorghum bicolor
MDGGDGGKEDGNNKQRLEWATMNLERGVVVGAGEKKGGNASRKPPIGIVRLFLACMVSGGIQYGWALQLSLLSPYSQTLGISHSYVSLTWICGPIAGFVVQPIVGYYSDRCTSKMGRRRPFILAGCIIICLSVMMIGFSADIGRRLGDTKEHCSTFTGSRWYAAAVYIVGFWFLDFANNTVQGPARAMMADLAAGHHGPNVGQAIFSLWMALGSVLGYLAGANAKWHEWLPWLKTAACCDACANLKGAFLTAVILIIVTMSVTLWLAGEELLDKANVDDASGGACSAFVDLFKSLKNLPPAMFSVLAVTAVTWLSWFPFIQYNTDWMGREIFHGEPQGAGGKADLYDAGVREGAVGLLFCSVLLGVTSFLIPKLCRKLTSRVVWSISNLMVFVLMTAMVALGIVSMKGYRPSLAASLSAGPDHRFKSGALAIFALIGIPQAVLFSVPWAVVSEVAAEEGGGQGLTIGVLNIAIVLPQLVIALSAGPIDGAFNKGNTPALGIGGVFALICAVLALVLLPKTRGVSNATVMAGGGH

SEQ ID NO: 66 - protein, 536 aa, Sorghum bicolor
MDDGDVGEEDANKQRLERATMNLERGVVAGEKGDGSGGNASRKPPIGIVRLFLACMVSGGIQYGWALQLSLLSPYSQTLGISHSYVSLTWICGPIAGFVVQPIVGYYSDRCTSKIGRRRPFILAGCIVICLSVLMIGFSADIGRRLGDTKEQCSTFTGSRWYAAAVYIVGFWFLDFANNTVQGPARAMMADLAAGQHGPNVGQAIFSLWLALGGVLGYLAGANARWHEWLPWLKTAACCDACANLKGAFLTALILIIITMSVTLWLAGEQQLDKDNVVDASGGACSLFVHLFKSLKNLPPAMLGVLAVTAVTWLSWFPFIQYNTDWMGREIFHGEPQGAGGKADLYNAGVREGAVGLLFCSVALGVTSFLLPKLCRKLTSRVVWSISNLMVFALLTAMVVLGMVSMKGYKPSLAASLSAGPDHTFKSAALAIFALIGIPQAVLFTVPCAVACEIATEEGGGQGLTLGVLNIAVVLPQLLIALSAGPIDGAFGKGNAPALGIGAVFALISAVLALVLLPKTRGVSNASATVMASGHC

SEQ ID NO: 67 - protein, 525 aa, Bambusa oldhamii
MEEGRSDLKEASRLERALSAESGGGGGDSGSDSGRKKFMRLLRLFFACMVSGGIQYGWALQLSLLSPYSQTLGISHTYVSLTWICGPISGFVVQPIVGYYSDRCTMRIGRRRPFILAGCLVICISVMLIGFSADIGRRLGDTKEHCSTYTGPRWSAAIVYIAGFWFLDFANNTVQGPARAMMADISAGHHGPSVGQAIFSLWMAIGSILGYLAGANAKWHEWFPSLKTAACCDACANLKGAFFTAVALIVISMTVTMLLADEKPLYKVDVDTSSGGGWSAFGDLFKSFKNLSPAMFKVLAVTAITWLSWFPFFQYNTDWMGREIYHGDPHGKGVKADSYNAGVREGAVGLLLCSISLGVTSFLIPKLCRKLTSKVVWSISNFLVFIIMTVMVVVGMVSMKGYRPSLSATLTGSDPTLKAIALTIFALIGVPQAVLFSVPWVVASEVAAEEGGGQGLTVGVLNIAIVVPQLIIALTAGPIDGAFNKGNTPAFGIGGAFAFICAVLALFLLPKTRGISHAAVVASGH

SEQ ID NO: 68 - protein, 530 aa, Zea mays
MGGHSKEDARRLEWATLNLERGVVGGGGETTGYGNASLKPAIGLVRLFSACMVSGGIQYGWALQLSLLSPYSQTLGISHSYVSLTWICGPIAGFVVQPIVGYYSDRCTSKMGRRRPFILAGCIIICLSVLMIGFSADIGRRLGDTTEHCSTFTGSRWYAAAVYIVGFWFLDFANNTVQGPARAMMADLAAGHHGPNVGQAIFSLWMALGSVLGYLAGANAKWHEWFPWLKTAACCDACANLKGAFLTAVVLIVVTMSATLWLAGEEQKQLDKDDVDASGGACSAFVDLFKCLKNLPPAMFSVLAVTAVTWLAWFPFFQYNTDWMGREIFHGEPQGAGGKADLYNAGVREGAVGLLLCSVALGVTSLLIPKLCRKLTSRVVWSVSNLMVFILMAAMVILGIVSMKGYQPSLAATLSAGPNHSFRAGALAIFAFIGIPQAVLYSVPWAVASEVAAKDGGGQGLTIGVLNIAIVLPQLVIALGAGPIDGAFNKGNTPAFGIGAVFAFICAVLALILLPRTRGVSNATVMAGGH

SEQ ID NO: 69 - protein, 530 aa, Zea mays
MNGDGSKEDANRRLEWATLNMERAVVVSETTKGDGNGNAGRKAPISIVRLFLACMVSGGIQYGWALQLSLLSPYSQTLGISHSYVSLTWICGPIAGFVVQPIVGYYSDRCTSKMGRRRPFILAGCIIICLSVLVIGFSADIGRRLGDTKEHCSTFTGSRWSAAAVYIVGFWFLDFANNTVQGPARAMMADLAAGQHGPNVGQAIFSLWMALGSVLGYLSGANAKWHDWLPWLKTAACCDACANLKGAFLTAVVLIIISMSVTLWLAGEERLDKESVDTSGGACSAFMDLFKSLKNLPPAMFSVLAVTAVTWLSWFPFFQYNTDWMGREIFHGEPQGSGSKADLYEAGVREGAIGLLFCSVALGVTSFFIPRLCRKLTSRVVWSVSSLMVFVLMTAMVVLGMVSMKGYRPSLAASLSGPDHSFKGGALAIFALIGIPQAVLYSVPWAVASEVATEDGGGQGLTIGVLNIAIVLPQLVIALGAGPIDGAFNKGNTPAFGIGAAFALICAVLALILLPKTRGVSNATVMAGGH

SEQ ID NO: 70 - protein, 507 aa, Pisum sativum
MPNPDSSRQPHRSKTRPSSSSVRSKPRPKDRVPLTKLLRVASVAGGIQFGWALQLSLLTPYVQQLGIPHAWASIIWLCGPLSGLIVQPLVGHLSDRCTSRFGRRRPFILGGAISIALSVLIIGHAADLGWKFGDTKEHRRSAVAFFVFGFWILDVANNVTQGPCRALLGDLTGKDHRRTRVANAYFSLFMAIGNILGYATGSYSGWYRVFPFTLTPACNISCANLKSAFFLDIVFMLITTYISITSANEVPLGSSGEPDAEAEGESGGSAEEAFLWELFGTFKYFSKPIWIVLSVTALTWVGWFPFLLFDTDWMGREIYGGEPNEGTNYDSGVRMGALGLLLNSVVLGVTSLLMEKLCRKRGAGFVWGIANILMAVCFIAMLVLTYVANDIGYLGKDLPPTSIVIAALTIFTVLGFPLAITYSVPYALISTHIQPLGLGQGLSMGVLNLAIVFPQMIVSLGSGPWDQLFGGGNSPAFAVAAIAALVSGGIAVFAIPRTGSQKPRNPV

SEQ ID NO: 71 - protein, 498 aa, Hevea brasiliensis
MAIPQAESHRARARPPVVRRVRLRQLLRVTSIAGGIQFGWALQLSLLTPYVQELGIPHAWASVIWLCGPLSGLVVQPLVGHMSDRCTSRFGRRRPFIFTGASLICFSVLIIGHSADIGWLLGDRGNTRPRAIGVFVFGFWILDVANNMTQGPCRALLADLTGKDHRRTRVANAYFSLFMAVGNILGFATGAFSKWFKVFPFTVTSACNVDCANLKSAFYLDIVFMVITAYLSITAAQESPLCLSDRSTPIAEDVSGQSSHAQEAFLWELFGTFRYFPWPVWTILLVTALNWIGWFPFLLFDTDWMGREIYGGKPNEGQNYNIGVRTGAFALMLNSVFLGVTSLFMERLCRKWGAGFIWGISNILMALCFLAMLITSYVANHIGYLGHDLPPHGIVIAAIVIFAVLGVPLAITYSVPYALISSRIEPLGLGQGLSMGVLNLAIVIPQVIVSLGSGPWDQLFGGGNSPAFAIGGLAAFAGGLVAILGIPRSGAQKPMALP

SEQ ID NO: 72 - protein, 498 aa, Hevea brasiliensis
MAIPQAESHRARARPPVVRRVPLRQLLRVTSVAGGIQFGWALQLSLLTPYVQELGIPHKWASIIWLCGPLSGLVVQPLVGHMSDRCNSRFGRRRPFIFAGAGLICFAVLIIGHSADIGWLLGDRGNTRPRAIGVFVFGFWILDVANNMTQGPCRALLADLTGKDHRRTRVANAYFSLFMAVGNILGYATGAFSNWFKVFPFTVTSACNADCANLKSAFYLDIVFMVITTYLSITAAQESPLGLSDRSTPIAADVSGQSSHAQEAFLWELFGTFRYFPWPVWTILLVTALNWIGWFPFLLFDTDWMGREIYGGKPNEGQNYNIGVRTGAFALMLNSVFLGITSVLMEKLCRKWGAGFIWGISNILMALCFLAMLITSYVANHIGYLGHDLPPNGIVITAVVIFAVLGVPLAITYSVPYALISSRIEPLGLGQGLSMGVLNLAIVTPQVIVSLGSGPWDQLFGGGNSPAFAVGALAAFAGGVVAILGIPRSGAPKPRAPP

SEQ ID NO: 73 - protein, 496 aa, Manihot esculenta
MAIPQAESHRARARPPVVRRVPLRQLLRVTSIAGGIQFGWALQLSLLTPYVQELGIPHAWASVIWLCGPLSGLVVQPLVGPMSDRCASRFGRRRPFILAGAILIVVAVLIIGHSADIGWLLGDRGNTRPRAIVVFVFGFWVLDVANNTTQGPCRALLADLTGKDHRRTRVANAYFSLFMAIGNILGFATGAFSNWFKVFPFTVTTACNVDCANLKSAFYLDIVFMVITSYLSITAAQESPLGLSNRSTPLAEDVSVESSQEAFLWELFGTFRYFPWPVWTILLVTALNWIGWFPFLLFDTDWMGREIYGGKPNEGQNYNVGVRAGSFALMLNSVFLGITSVLMEKLCRKWGAGFIWGLSNILMALCFLAMLITSYVANHIGYLGHDLPPSGIVISAVVIFAVLGVPLAITYSVPYALISSRIEPLGLGQGLSMGVLNLAIVIPQVIVSLGSGPWDQLFGGGNSPAFAVGGLAALAGGLIAILGIPRSGTQKPRALP

SEQ ID NO: 74 - protein, 501 aa, Vitis vinifera
MAVPGGHRQRGRPRALIGEPVRPRVPLRRLLRVASVACGIQFGWALQLSLLTPYVQELGIPHAWSSIIWLCGPLSGLLVQPLVGHLSDRCNSRFGRRRPFIVAGATSIVVAVLIIGFSADIGGLLGDGADRRPRAVATFVVGFWLLDVANNVTQGPCRALLADLTEKDHRRTRVANAYFSLFIAVGNVLGFATGSYSGWFRIFWFTSTSSCNADCANLKSAFLLDIIFIAITTYISITAAQELPLSSSSRSTHISEEMAESTHAQEAFLWELFGTLRYLSGSIWIILFVTALTWIGLLPFLLFDTDWMGREIYGGKPNEGQNYNTGVRMGALGLMLNSVVLGITSVLMEKLCRKWGAGFVWGLSNILMSLCFLLMLILSAVVKHMDFLGHDLPPSGVVIAALIVFSILGIPLAITYSVPYALISTRIESLGLGQGLSMGVLNLAIVIPQVIVSLGSGPWDQLFGGGNSPSLAVAAVAAFASGLVAILAIPRSSADKSRVHT

SEQ ID NO: 75 - protein, 500 aa, Solanum tuberosum
MPEIERHRTRHNRPAIREPVKPRVPLRLLFRVASVAGGIQFGWALQLSLLTPYVQELGIPHAWASIIWLCGPLSGLLVQPLVGHMSDKCTSRFGRRRPFIVAGAVSIMIAVLIIGFSADIGWLLGDRGEIKVRAIAAFVVGFWLLDVANNMTQGPCRALLADLTQKDHRRTRVANAYFSLFMAIGNILGFATGSYSGWFKIFPFTLNTACTINCANLKAAFIIDIIFIATTTCISISAANEQPLDPSRGSSHTREEIGESSHGQEEAFLWELFGIFKYFPGVVWVILLVTALTWIGWFPFLLFDTDWFGREIYGGEPNDGKNYSAGVRMGSLGLMLNSVLLGLTSLFMEKLCRKWGAGFTWGVSNVVMSLCFIAMLIITAVRSNIDIGQGLPPDGIVIAALVVFSILGIPLAITYSVPYALVSSRIDALGLGQGLSMGVLNLAIVFPQIVVSLGSGPWDELFGGGNSPAFVVAALSAFAGGLIAILAIPRTRVEKPKIFA

SEQ ID NO: 76 - protein, 501 aa, Daucus carota
MAGPEADRNRHRGGATAAPPPRSRVSLRLLLRVASVACGIQFGWALQLSLLTPYVQELGIPHAWSSIIWLCGPLSGLLVQPIVGHMSDQCTSKYGRRRPFIVAGGTAIILAVIIIAHSADIGGLLGDTADNKTMAIVAFVIGFWILDVANNMTQGPCRALLADLTGNDARRTRVANAYFSLFMAIGNVLGYATGAYSGWYKVFPFSLTSSCTINCANLKSAFYIDIIFIIITTYISISAAKERPRISSQDGPQFSEDGTAQSGHIEEAFLWELFGTFRLLPGSVWVILLVTCLNWIGWFPFILFDTDWMGREIYGGEPNQGQSYSDGVRMGAFGLMMNSVVLGITSVLMEKLCRIWGSGFMWGLSNILMTICFFAMLLITFIAKNMDYGTNPPPNGIVISALIVFAILGIPLAITYSVPYALVSTRIESLGLGQGLSMGVLNLAIVVPQVIVSLGSGPWDQLFGGGNSPAFVVAALSAFAAGLIALIAIRRPRVDKSRLHH

SEQ ID NO: 77 - protein, 501 aa, Zea mays
MPPRTAPAATSTPPRKVPLRKLLRAASVACGVQFGWALQLSLLTPYVQELGIPHAFASLVWLCGPLSGLLVQPLVGHLSDRIGPAASPLGRRRPFIAAGAACIAAAVLTVGFSADLGRLFGDDVTPGSTRLGAICVYLVGFWLLDVGNNGTQGPCRAFLADLTENDPRRTRIANAYFSLFMALGNILGYATGAYSGWYSIFPFTVTESCGISCANLKSAFLLDIIVLVITTYTTVTSVQEPQTFGSDEAQNSGAEQEAFLWELFGSLRYFTLPIWMVLIVTALTWMAWFPFTLFDTDWMGREIYRGSPDNPGETQRYHDGVRMGSFGLMLNSVVLGFTSVVLEKLCRKWGAGLVWGVSNILMTLCFLAMLVITYVAKNMDYPSSGAPPTGIVVASLVVFTILGAPLAITYSIPYAMAASRVENLGLGQGLAMGILNLAIVIPQVIVSLGSGPWDQLFGGGNAPAFAVAAGASFIGGLVAILGLPRARIASSSSRRRGGTHR

SEQ ID NO: 78 - protein, 501 aa, Sorghum bicolor
MPPRTAPAAPTPPRKVPLRKLLRAASVACGVQFGWALQLSLLTPYVQELGIPHAFASLVWLCGPLSGLLVQPLVGHLSDRLAPAASPLGRRRPFIAAGAASIAAAVLTVGFSADLGRLFGDDVTPGSTRLGAICVYLVGFWLLDVGNNATQGPCRAFLADLTENDPRRTRIANAYFSLFMALGNILGYATGAYSGWYSIFPFTVTESCGVSCANLKSAFLLDIIILVITTYITVASVQEPQTFGSDEAQNPGAEQEAFLWELFGSLRYFTLPIWMVLIVTALTWIAWFPFTLFDTDWMGREIYRGSPDNPGETQRYHDGVRMGSFGLMLNSVVLGFTSVVLEKLCRKWGAGLVWGVSNIIMTLCFLAMLVITYVAQNMDYPSTGEPPTGIIVASLVVFTILGAPLAITYSIPYAMAASRVENLGLGQGLAMGILNLAIVVPQVIVSLGSGPWDQMFGGGNAPAFAVAAGSSFIGGLVAILGLPRARIASSSSSRRRGGTHR

SEQ ID NO: 79 - protein, 501 aa, Oryza sativa
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 80 - protein, 506 aa, Hordeum vulgare
MPPRRPNTGGGGGTSSSAAPAPRKVPLRSLLRAASVACGVQFGWALQLSLLTPYVQELGIPHAFASLVWLCGPLSGLLVQPLVGHLSDRITPANSPLGRRRPFIAAGAASIAFAVLTVGFSADLGRLFGDNVVPGSTRIGAIIVYLVGFWLLDVGNNATQGPCRAFLADLTENDPRRTRIANAYFSLFMALGNILGYATGAYNGWYKIFPFTITGSCGVSCANLNSAFLLDIIILAITTYISVATVQDNPTFGSDEAAPPSSHEEEAFLFELFGSFKYFTMPVWMVLIVTSLTWVGWFLFILFDTDWMGREIYRGSPEIVADTQKYHDGVRMGSFGLMLNSVVLGITSIGMEKLCRKWGAGLVWGVSNIIMALCFVAMLIITYVAQNLDYGPSGAPPTGIVAASLIVFTILGAPLSITYSIPYAMAASRVENLGLGQGLAMGILNLSIVIPQIIVSLGSGPWDQLFGGGNAPSFWVAAAASFVGGLVAILGLPRARLGPKKKTTQR

SEQ ID NO: 81 - protein, 499 aa, Malus domestica
MPAPDTDRHRVGARPAVRTRVPLRQLLRVASVACGIQFGWALQLSLLTPYVQELGIPHAWASVIWLCGPLSGLVVQPLVGHMSDRCTSRYGRRRPFIVVGAACIAVSVLIIGFSADIGWLLGDRGGGVRPRAIAVFVFGFWILDVANNVTQGPCRALLADLTEKDYRRTRVANAYFSLFMAVGNVLGYATGSISYLFKVFPFSITPACNVNCANLKSAFFVDTAFIAITTWISISAAQVTPLGSSNRTTPFADEGPGQSSHIEEAFLWELFGTFRYFPGSVWLILLVIALNWIGWFPFLLFDTDWMGREIYGGKPNEGINYSTGVRMGALGLMLNSVILGITSVLMEKLCRKWGAGFVWGISSILMTLCFFAMLVITFVNKSIGVRGHDLPPDGIVIAALVVFAVLGIPLAITYSVPYALVSSRIESLGLGQGLSMGVLNLAIVIPQVIVSLGSGPWDQLFGGGNVPAFAVAAVASLASGLVAILAIPRSAAPKPRAVT

SEQ ID NO: 82 - protein, 498 aa, Datisca glomerata
MVIPEADRHRARARPPVQARVSLRKLLRVSSVACGIQFGWALQLSLLTPYVQELGIPHAWASVIWLCGPLSGLFVQPLVGHMSDRCTSRFGRRRPFIVVGALSITVAVLIIGYSADIGSLIGDRGTVKPGAIATFVVGFWILDVANNMTQGPCRALLADLTGKDHRRTRVANAYFSLFMAVGNVLGYATGSYSGWFKIFPLTLTSACNVNCANLKSAFLLDIVFIAITTYLSISAAQESPLDPTDRSANITEEGPGPSSHTEEAFLWELFGAFRYFSASIWVIFFVTALTWIGWFPFLLFDTDWMGREIYGGKPNEGQNYSTGVRMGALGLMLNSVVLGITSVLMEKLCRYWGAGFVWGVSNILMSLCFLAMLVVTFVAKRIDYIGHKLPPDVIVVAALVIFAILGIPLAITYSVPYALISTRIESLGLGQGLSMGVLNLAIVIPQVVVSLGSGPWDQLFGGGNSPAFAVAAVAAFASGLVAILAIPRSRAQKPRALT

SEQ ID NO: 83 - protein, 511 aa, Lotus japonicus
MPGDPDNRHHHHPRSKNRPSTSSARPPPSRPPPARVPLRQLLRVASVASGIQFGWALQLSLLTPYVQQLGIPHQWASIIWLCGPVSGLFVQPLVGHLSDKCTSRFGRRRPFILAGAASIVVAVLIIGYAADIGWMLGDTESFRPAAITVFVIGFWILDVANNVTQGPCRALLADLTSKDNRRTRVANAYFSLFMAIGNILGYATGAYSGWYRIFTFTLSPACTISCANLKSAFFLDVAFIAVTTYVSITAAHEVPLNSSGAAHAGEGAGESGSTEEAFMWELFGTFKYFSSTVWIILSVTALNWTGWFPFILFDTDWMGREIYGADPNGGPNYDAGVRMGALGLMLNSVVLGVTSLLMEKLCRKRGAGFVWGISNILMAVCFLAMLVVTYVANTIGYVGKDLPPTGIVIAALIIFTILGFPLAITYSVPYALISKHTEPLGLGQGLSMGVLNLAIVIPQIVVSLGSGPWDQLFGGGNSAAFAVGAVAAIMSGLLAVLAIPRTGTQKPQIRV

SEQ ID NO: 84 - DNA, 1610 bp, Paspalum notatum
gcgggatggcgcgcaccgcccctccgccgccgccgccggcgcgcaaggttcccctgcggaagctgctgcgcgcggcgtcggtagcgtgcggggtgcagttcgggtgggcgctgcagctgtcgctgctgaccccctacgtgcaggagctgggcatcccgcacgccttcgccagcctcgtctggctctgcggcccgctctcggggctcctcgtccagcccctcgtcggccacctctccgaccgcatcgcgcccgccgcctcgccgctcgggcggcgcaggcccttcatcgccgcgggggcagcgtccatcgcggccgccgtcctcaccgtcggcttctccgccgacctgggccggctcttcggcgacgacgtcacgccgggctccacacgcctcggcgcaatctgcgtctacctcgtcggattctggctgctcgatgtcggcaacaacgccacgcaggggccctgcagggccttcctagcggacctcacagagaacgacccaaggaggactcgcattgccaatgcatacttttcactcttcatggccctgggaaacatacttggatatgccaccggagcatacagtggctggtataggatatttcctttcacagttacagaatcctgcggcatcagttgtgccaacctcaagtccgcctttcttcttgacattattattctggtgattacaacgtacatcactgtagcatcagtgcaagagccgcaatcttttggaggtgatgaagcagaacatccaagcactgaacaggaagctttcctctgggaactttttgggtcattcagatacttcacactaccagtttggatggtcttaattgtcactgcccttacatggatcggatggtttccttttatcctctttgatactgattggatgggccgagagatctaccgaggaagcccagacatcccaggagagacccaaagataccatgatggtgtgagaatgggttcttttggtctgatgctgaactctgttcttcttggattcacctctgttgtactagagaagttatgtagaaaatggggagctggactagtgtggggtgtctccaatatactgatggctttgtgcttcgtggcaatgcttgtaataacatatgtcgcaaagaacatggattatccacccagcggatcgcctccaaccggcattgtcattgcttctctggtggtttttacaattttaggaacacccctagcgatcacatacagtataccatatgcaatggctgctagtcgtgttgaaaatctgggtcttggccaaggtctagcaatgggtattctcaatttagctattgtcataccacaggtgattgtgtcacttggtagtggaccatgggatcaactgttcggcggtgggaatgccccggcttttgcagtggcagcaggtgcagccttcattggtgggctggtggctattctggggcttccacgagcacgcattgcatcatcgtcgtcatcgaggaggagaggcgggacaaaccgacgataagctgctgcttgttacggtcgcatgcataagcataactgggcaagtgtttccgctttgcaacaattcgttgcggttggttgggcttaggcacatatcaag

SEQ ID NO: 85 - protein, 501 aa, Paspalum notatum
MARTAPPPPPPARKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRLFGDDVTPGSTRLGAICVYLVGFWLLDVGNNATQGPCRAFLADLTENDPRRTRIANAYFSLFMALGNILGYATGAYSGWYRIFPFTVTESCGISCANLKSAFLLDIIILVITTYITVASVQEPQSFGGDEAEHPSTEQEAFLWELFGSFRYFTLPVWMVLIVTALTWIGWFPFILFDTDWMGREIYRGSPDIPGETQRYHDGVRMGSFGLMLNSVLLGFTSVVLEKLCRKWGAGLVWGVSNILMALCFVAMLVITYVAKNMDYPPSGSPPTGIVIASLVVFTILGTPLAITYSIPYAMAASRVENLGLGQGLAMGILNLAIVIPQVIVSLGSGPWDQLFGGGNAPAFAVAAGAAFIGGLVAILGLPRARIASSSSSRRRGGTNRR

SEQ ID NO: 86 - protein, 492 aa, Arabidopsis thaliana
MSDLQAKNDVVAVDRQSSSSLADLDGPSPLRKMISVASIAAGIQFGWALQLSLLTPYVQLLGVPHKWSSFIWLCGPVSGLLVQPSVGYFSDRCTSRFGRRRPFIATGALLVAVAVVLIGYAADFGHSMGDKIDKPVKMRAVVIFALGFWILDVANNTLQGPCRAFLGDLAAGDAKKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGALGLMLNSIVLGIVSLGIEGISKKIGGAKRLWGAVNIILAVCLAMTVLVTKKAEEHRRIAGPMALPTDGIRAGALTLFALLGIPLAITFSIPFALASIISSSSGAGQGLSLGVLNMAIVIPQMIVSFGVGPIDALFGGGNLPRFVVGAIAAAISSVVAFTVLP

SEQ ID NO: 87 - protein, 491 aa, Arabidopsis thaliana
MSDLQANKDETTVDRQSSSSVDLDGPSPLRKMISVASIAAGIQFGWALQLSLLTPYVQLLGVPHKWPSFIWLCGPVSGLLVQPSVGYFSDRCTSRFGRRRPFIATGALLVAVSVVLIGYAADFGHSMGDKIDKPVKMRAVVIFALGFWILDVANNTLQGPCRAFLGDLAAGDAQKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGALGLMLNSIVLGVMSLGIEGISRKMGGAKRLWGAVNIILAVCLAMTVLVTKKAEEHRRIAGPMALPTDGIRAGALTLFALLGIPLAITFSIPFALASIISSSSGAGQRLSLGVLNMAIVIPQMIVSFGVGPIDALFGDGNLPGFVVGAIAAAVSSIVAFTVLP

SEQ ID NO: 88 - protein, 492 aa, Arabidopsis thaliana
MSDLQANKDAAAVNRQSSSSSADLNGPSPMRKMISVASIAAGIQFGWALQLSLLTPYVQLLGVPHKWSSFIWLCGPVSGLLVQPSVGYFSDRCKSRFGRRRPFIAMGALLVAVAVVLIGYAADFGHSMGDKVDEPVKMRAVVIFALGFWILDVANNTLQGPCRAFLGDLAAGDAKKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGGLGLMLNSIVLGFMSLGIEGISRKMGGAKRLWGAVNIILAVCLAMTVLVTKKAEEHRRIAGPMALPTDGIRAGALTLFALLGIPLAITFSIPFALASIISSSSGAGQGLSLGVLNMTIVIPQMVVSFGVGPIDALFGGGNLPGFVVGAIAAAISSVVAFSVLP

SEQ ID NO: 89 - protein, 491 aa, Arabidopsis thaliana
MSDIQAKEDAAPVDRQSSSSVVVPDEPSPLRKMISVASIAAGIQFGWALQLSLLTPYVQLLGVPHKWSSFIWLCGPISGLLVQPTVGYFSDRCKSRFGRRRPFIATGALLVALAVILIGFAADFGHTMGDKLDEAVKIRAVGFFVVGFWILDVANNTLQGPCRAFLGDLAAGDAKKTRTANAIFSFFMAVGNVLGYAAGSYTNLHKIFPFTVTKACDIYCANLKSCFIISITLLIVLTIIALWYVEDKQWSPNADSDNEKTPFFGEIFGAFKVMKRPMWMLLAVTALNWIAWFPFLLYDTDWMGREVYGGDSAGDDKMKKLYNHGIQVGSLGLMLNSIVLGVMSLVIGVISKKIGAKRLWGAVNIILAVCLAMTVLVTKKAEEHRKIAGRMALPTNAIRDGALSLFAILGIPLAITFSIPFALASIISSSSGAGQGLSLGVLNMAIVIPQMIVSFGVGPIDALFGGGNLPGFVVGAIAALISSVVALTVLP

SEQ ID NO: 90 - protein, 513 aa, Arabidopsis thaliana
MGAYETEKPTKDAAALETQSPEDFDQPSPLRKIISVASIAAGVQFGWALQLSLLTPYVQLLGIPHKWSSLIWLCGPVSGMIVQPIVGFHSDRCRSKFGRRRPFIATGAALVAVAVFLIGYAADFGYKMGDKLEEKVKVRAIGIFALGFWILDVANNTLQGPCRAFLADLAAGDAKRTRVANAFFSFFMAVGNVLGYAAGSYTNLHKMFPFTMTKACDIYCANLKTCFFLSITLLLIVTVTSLWYVNDKQWSPPPRNADDDEKTSSVPLFGEIFGAFKVMKRPMWMLLIVTALNWIAWFPFLLFDTDWMGREVFGGDSDGNERSKKLYSLGVQSGAMGLMFNSIVLGFMSLGVEWIGRKLGGAKRLWGIVNFILAAGLAMTVLVTKFAEDHRKTAGDLAGPSASVKAGALSLFAVLGIPLAITFSTPFALASIFSSCSGAGQGLSLGVLNLAIVIPQMIVSLGGGPFDALFGGGNLPAFIVAAIAAAISGVLALTVLPSPPPDAPKATTMGGFH

SEQ ID NO: 91 - protein, 512 aa, Arabidopsis thaliana
MGALEAERAANNATALETQSSPEDLGQPSPLRKIISVASIAAGVQFGWALQLSLLTPYIQLLGIPHKWSSYMWLCGPISGMIVQPIVGYHSDRCESRFGRRRPFIAAGVALVAVSVFLIGFAADMGHSFGDKLENKVRTRAIIIFLTGFWFLDVANNTLQGPCRAFLADLAAGDAKKTRVANACFSFFMAVGNVLGYAAGSYTNLHKMFPFTMTKACDIYCANLKTCFFLSITLLLIVTFSSLWYVKDKQWSPPQGDKEEKTSSLFFFGEIFGAVRHMKRPMVMLLIVTVINWIAWFPFILYDTDWMGREVYGGNSDGDERSKKLYDQGVQAGALGLMFNSILLGFVSLGVESIGRKMGGAKRLWGCVNFILAIGLAMTVLVTKSAEHHREIAGPLAGPSSGIKAGVFSLFTVLGIPLAITYSIPFALASIFSTNSGAGQGLSLGVLNIAICIPQMIVSFSSGPLDAQFGGGNLPSFVVGAIAAAVSGVLALTVLPSPPPDAPAMSGAMGFH

SEQ ID NO: 92 - protein, 507 aa, Glycine max
MEQPPSSSLQVETAQQAGPSPLRKMIAVSSIAAGIQFGWALQLSLLTPYVQTLGVPHAWASFIWLCGPISGLLVQPIVGYSSDRCRSRFGRRRPFILAGAVAVAIAVFLIGYAADIGHAAGDDLAKKTRPRAVAIFVVGFWILDVANNMLQGPCRAFLGDLAAGDHRKTRTANAFFSFFMAIGNVLGYAAGSYDKLHRAFKFTQTEACDVFCANLKSCFFFSIVLLLVLCFVVLTCVEDPQFTPRGDEDNYENDGVSRSWFSCFGELCGAFRGLKRPMWLLMLVTAINWVAWFPYVLFDTDWMGREVYGGKVGDKAYDSGVHVGALGLMLNSVVLALMSLAVEPLGRLVGGVKWLWGIVNVILAVCMAMTVLITKAAEHERLNAVSLVGYPSLGVKAAALTFFSVLGVPLAITYSVPFALASIYSTTSGAGQGLSLGVLNVAIVVPQMIVSAISGQWDKWFGGGNLPAFVLGAVAAAVSAVLAVVLLPKPKPADVAKVSSVTAGSFH

SEQ ID NO: 93 - protein, 504 aa, Glycine max
MEQPPSSSLQVETAQQPGPSPLRKMFAVSSIAAGIQFGWALQLSLLTPYVQTLGVPHAWASFIWLCGPISGLLVQPIVGYSSDRCRSRFGRRRPFIFVGAIAVAIAVFLIGYAADIGHAAGDDLTKKTRPRAVVVFVVGFWILDVANNMLQGPCRAFLGDLAAGDHRKTRTANAFFSFFMAIGNVLGYAAGSYDKLHRAFKFTQTEACDVFCANLKSCFFFSIVLLLVLCFVVLICVDDPQFTPRGDDNNGENDGVSGSCFGELWAAFKGLKRPMWLLMVVTAINWVAWFPYMLFDTDWMGREVYGGKVGEKAYDSGVHKGALGLMLNSVVLALMSLTVEPLGRFVGGVKWLWGIVNVILAVCMAMTVVITRAAEHERKNGVSAVGHPSVGVQVAALTFFSALGVPLAITFSVPFALASIYSSTSGAGQGLSLGVLNVAIVVPQMIVSAISGQWDKWFGGGNLPAFVLGAVAAAVSAVLAVVLLPTPKPADVAKVTSVTAGSFH

SEQ ID NO: 94 - protein, 503 aa, Phaseolus vulgaris
MEPSSSSLQVETGERQQPSPLRKMFAVSSIGAGIQFGWALQLSLLTPYVQTLGVPHAWSSFIWLCGPISGLLVQPIVGYSSDRCTSRFGRRRPFILSGAVAVAISVFLIGYAADIGHATGDDITKKTRPRAVAIFVVGFWILDVANNMLQGPCRAFLGDLAAGDQKKTRTANAFYSFFMAIGNVLGYAAGSYDKLHHLFRFTETEACGVFCANLKSCFFFSIVLLLVLCAIVLTCVDDPQFTPDCVNANNPQTGSWYSCFGELGIAFKGLQKPMLMLMLVTAINWVAWFPYVLYDTDWMGREVYGGEVGSNAYDNGVHAGSLGLMLNSVVLAVMSLVVEPLGRVVGGVKWLWAAVNVILAVCMAMTVVITKAARHERNHDGVLVGHPSFGVKAGAMSFFSILGIPLAITYSVPFALASIYSSTSGAGQGLSLGLLNVAIVVPQMIVSAISGPWGSWFGGGNLPAFVLGAVAAAVSAVLAVVMLPSPKPADVSKASSVTVGNFH

SEQ ID NO: 95 - protein, 494 aa, Glycine max
MEEPQPGPNPLRKMILVSSMAAGIQFGWALQLSLLTPYVQTLGVPHAWASFIWLCGPISGLLVQPIVGYSSDRCQSRFGRRRPFILAGSLAVAIAVFLIGYAADIGHAAGDNLTQKTRPRAVAIFVIGFWILDVANNMLQGPCRAFLGDLAAGDEKKTKAANAFFSFFMAVGNILGYAAGSYDGLHRLFPFTETEACNVFCANLKSCFFFAIVLLVVLTTLVLITVKETPYTPKAEKETKDAEKTHFSCFCGELCLAFKGLKRPMWMLMLVTAVNWIAWFPYFLFDTDWMGREVYGGDVGQKAYDSGVHAGSLGLMLNAMVLAVMSLAIEPLGRVVGGIKWLWGIVNILLAICLGMTVLITKIAEHERLLNPALVGNPSLGIKVGSMVFFSVLGIPLAITFSVPFALASIYSSTSGAGQGLSLGVLNIAIVVPQMIVSTISGPWDALFGGGNLPAFVLGAVAAVVSAILAVLLLPTPKKADEVRASSLNMGSLH

SEQ ID NO: 96 - protein, 476 aa, Phaseolus vulgaris
GGSGVQFGWALQLSLLTPYVQTLGVPHAWASFIWLCGPISGLLVQPIVGYSSDRCQSAFGRRRPFILAGALAVAIAIILIGYAADIGQLAGDDITQKTRPRAVAIFVVGFWILDVANNMLQGPCRAFLGDLAAGDQKKTRTANSFFSFFMAVGNVLGYAAGSYDGLHKIFPFTETEACNVFCANLKSCFFFSIVLLLALCIIVLTCVNDPQYIPSNPEKEAEEEGKTQVSCFLGECCVAFKGLQRPMWMLMLVTAINWIACFPYVLFDTDWMGREVYGGDVGQKAYDAGVHAGSLGLMLNSVVLAVMSLAVEPLGRLVGGVKWLWAIVNVILAACMALTVLITKVAEQQRALNPALIGNPSMEVKGGAMAFFSVLGIPLAITYSVPFALASIYSSTSGAGQGLSLGLLNVAIVIPQMIVSAISGPWDDWFGGGNLPAFVLGAGAAAISAILAVILLPSPKKEDEAKISSLSMGSFH

SEQ ID NO: 97 - protein, 511 aa, Glycine max
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFLFDTDWMGREVYGGTAGEDAYAKGVRVGSLGLMVNAVVLGFMSLAVEPLGKMVGGVKRLWAIVNFILAIGFGMTVVITKVAEHQRRMNPAAVGHPSEGVVVGSMVFFGVLGVPLAITFSVPFALASIYCSASGAGQGLSLGVLNLAIVVPQMVVSALSGPWDSLFGGGNLPAFMVGAAAAALSAIMAIVLLPTPKPADEAKASSMMAGGFH

SEQ ID NO: 98 - protein, 511 aa, Glycine max
MEAPSPTKPNDPTKPSNTSTTLSLEAGPAQASPLRKMFAVASIAAGIQFGWALQLSLLTPYVQLLGVPHAAASFIWLCGPISGLVVQPIVGYYSDHCTSRFGRRRPFILGGALAVAVAVFLIGYAADIGYAAGDDISKTTRPRAVGVFVIGFWILDVANNMLQGPCRAFLADLAAGDQRKTRIANGFFSFFMAVGNVLGYAAGSYKGLHKMFPFTETKACDVFCANLKSCFFFSILLLLFLATVALLYVKDKQVEARALDDATQPSCFFQLFGALKELKRPMWMLMLVTAVNWVGWFPYFLFDTDWMGREVYGGQVGEDAYANGVRVGSLGLMVNAVVLGFMSLAVEPLGKMVGGVKRLWAIVNFILAIGFGMTVVITKVAEHQRKMNPAAVGHPSEGVVVGSMVFFGVLGVPLAITFSVPFALASIYCSASGAGQGLSLGVLNLAIVVPQMVVSTLSGPWDALFGGGNLPAFMVGAAAAALSAIMAIVLLPTPKPADEAKASSMMAGGFH

SEQ ID NO: 99 - protein, 509 aa, Phaseolus vulgaris
MEAPSPTKPIDPTKPSITTLSVEGSQGEPSPLRKMFAVASIAAGIQFGWALQLSLLTPYVQLLGVPHAAASFIWLCGPISGLVVQPIVGYYSDRSTSRYGRRRPFILGGAVAVAIAVFLIGYAADIGYSAGDDITKKTRPRAVAVFVIGFWILDVANNMLQGPCRAFLADLAAGDQRKTRIANGFFSFFMAVGNVLGYAAGSFSGLHKIFPFTQTKACDVFCANLKSCFFFSILLLLFLSTVALIYVKDKPVAARAVQEDAQPSCFFQLFGALKELKRPMWMLMLVTAVNWIGWFPYFLFDTDWMGREVYGGTAGEDAYAEGVRVGSLGLMINAVVLGFMSLAVEPLDRMVGGVKRLWGIVNFILAIGFGMTVVITKMAEHQRHLNPAAVGHPSDGVKIGSMVFFAVLGVPLAITFSVPFALASIYSSASGAGQGLSLGVLNLAIVVPQMVVSALSGPWDALFGGGNLPAFMVGAAAAALSAIMAIVLLPTPKPADEAKAASMVAGGFH

SEQ ID NO: 100 - protein, 511 aa, Pisum sativum
  misc_feature (322)..(322): Xaa can be any naturally occurring amino acid
MDNPSTNESSNISSIHLESASNRKPTPLIKMIAVASIAAGIQFGWALQLSLLTPYIQLLGVPHKWAANIWLCGPISGMIIQPIVGYYSDRNRSRFGRRRPFIFFGAIAVAVAVFLIGFAADIGHSFGDDLKKKTRPKAVVIFVFGFWILDVANNMLQGPCRAFIGDLAADDHRRMRTGNALFSFFMAVGNVLGYAAGSYRKLFMMLPFTKTEACNEFCANLKTCFFIAIFLLVLLSTFALLYVEDIPLPSIESQSQTQTQTQSEPEQQVSCFGEILGAFNGLQKPMWMLMLVTAINWIAWFPFFLFDTDWMGHEVYGGNPGXDAYNRGVRAGAMGLMINAVVLALMSLAVEPLGRFVGGAKRLWGIVNIILAVGLAMTIVITKAAQHERHVSNGNTPSAGISAASFAFFALLGIPLAINFSVPFALASIYSSASGAGQGLSLGVLNIAIVVPQMIVSALSGPWDSLFGGGNLPAFVVGIGAAVISGVLAIIILPTPKATDVAKVPIAGGFH

SEQ ID NO: 101 - protein, 521 aa, Glycine max
MEPLSSTKHNNNLSKPSSLHTEAPPPEASPLRKIMVVASIAAGVQFGWALQLSLLTPYVQLLGIPHTWAAFIWLCGPISGMLVQPIVGYHSDRCTSRFGRRRPFIAAGSLAVAIAVFLIGYAADLGHMFGDSLAKKTRPRAIAIFVVGFWILDVANNMLQGPCRALLADLCAGDHRKTRNANAFFSFFMAVGNVLGYAAGSYSGLHNVFPFTKTKACDVYCANLKSCFFLSIALLLTLSTIALTYVKEKTVSSEKTVRSSVEEDGSHGGMPCFGQLFGAFRELKRPMWILLLVTCLNWIAWFPFLLFDTDWMGREVYGGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPQMVVSVISGPWDALFGGGNLPAFVVGAVAAAASGILSIILLPSPPPDLAKAATAAGGGFH

SEQ ID NO: 102 - protein, 524 aa, Pisum sativum
MEPLSSTKQINNNNNNLAKPSSLHVETQPLEPSPLRKIMVVASIAAGVQFGWALQLSLLTPYVQLLGIHHTWAAYIWLCGPISGMLVQPVVGYHSDRCTSRFGRRRPFIAAGSIAVAIAVFLIGYAADLGHSFGDNLDKKVRPRAIGIFVVGFWILDVANNMLQGPCRALLGDLCAGNQRKTRNANAFFSFFMAVGNVLGYAAGAYSKLYHVFPFTKTEACNVYCANLKSCFFLSIALLTVLATAALIYVKETPLIAEKAVVTAEDGGSNGGMPCFGQLSGAFKELKRPMWILLLVTCLNWIAWFPFLLFDTDWMGKEVYGGTVGEGHAYDMGVRAGALGLMLNSVVLGATSLGVDILARGVGGVKRLWGIVNFLLAICLGLTVLVTKLAQHSRQYAPGTGGLQDPLPPSGGIKAGALTLFSVLGIPLAITYSIPFALASIFSSTSGAGQGLSLGVLNLAIVIPQMFVSVLSGPWDALFGGGNLPAFVVGAVAALASGILSMILLPSPPPDMAKSVSATGGGFH

SEQ ID NO: 103 - protein, 523 aa, Vicia faba
MEPLSSTKQINNNNNLAKPSSLHVETQPLEPSPLRKIMVVASIAAGVQFGWALQLSLLTPYVQLLGIHHTWAAYIWLCGPISGMLVQPIVGYHSDRCTSRFGRRRPFIAAGSIAVAIAVFLIGYAADLGHSFGDSLDQKVRPRAIGIFVVGFWILDVANNMLQGPCRALLGDLCAGNQRKTRNANAFFSFFMAVGNVLGYAAGAYSKLYHVFPFTKTKACNVYCANLKSCFFLSIALLTVLATSALIYVKETALTPEKTVVTTEDGGSSGGMPCFGQLSGAFKELKRPMWILLLVTCLNWIAWFPFLLFDTDWMGKEVYGGTVGEGHAYDMGVREGALGLMLNSVVLGATSLGVDILARGVGGVKRLWGIVNFLLAICLGLTVLVTKLAQHSRQYAPGTGALGDPLPPSEGIKAGALTLFSVLGVPLAITYSIPFALASIFSSTSGAGQGLSLGVLNLAIVIPQMFVSVLSGPWDALFGGGNLPAFVVGAVAALASGILSIILLPSPPPDMAKSVSATGGGFH

SEQ ID NO: 104 - protein, 531 aa, Hevea brasiliensis
MEADPRKEPKLASSDHPLPPPPPPSSASIRKIVMVASIAAGIQFGWALQLSLLTPYVQLLGIPHTWAAFIWLCGPISGMLVQPIVGYHSDRCASRFGRRRPFIAAGSFAVAVAVFLIGYAADLGHLSGDPIAKSPKPRAIAVFVVGFWILDVANNMLQGPCRALLADLSGSNQKKTRTANALFSFFMAVGNVLGFAAGAYTHLYKIFPFTKTKACDVYCANLKSCFFISIFLLLTLTVLALTYVHEKQWSPEQGNAAAGDAEEEEDGPFESSPMPFFGEIFAALKNLQKPMWILLLVTCLNWIAWFPFLLFDTDWMGREVYGGDSNGTAEQVRLYDHGVRAGALGLMLNSVVLGFTSLGVEVLARAVGGVKRLWGIVNFILALCLFMTILITKMAESNRRFTTVRGGATVPLPPPGGVKAGALALFAVMGVPQAITYSIPFALASIFCNTAGAGQGLSLGVLNLSIVIPQMLVSVASGPWDALFGGGNLPAFVVGAIAAAASGIFAFTLLPSPPPDVPSAKASRAVTAAFH

SEQ ID NO: 105 - protein, 535 aa, Hevea brasiliensis
METDPTKESKLPSSEPLPTPPPLAPPPPASSKLRKIVMVASIAAGIQFGWALQLSLLTPYVQLLGIPHTWAAFIWLCGPISGMLVQPIVGYHSDRCTSRFGRRRPFIAGGALAVAVAVFLIGYAADLGQLSGDPVAKSPKPRAIAVFVVGFWILDVANNMLQGPCRALLADLSGANQKKTRIANALYSFFMAVGNVLGFAAGSYTHLYKIFPFTKTKACDVYCANLKSCFFISIVLLLTLTVLALIYVREKPWSPERGNTAAGDEEEEDEGASESSPMPFFSEIFASLKNLQKPMWILLLVTCLNWVAWFPFLLFDTDWMGREVYGGDSNGNPDQVRLYDRGVRAGALGLMLNSVVLGFTSLGVEVLARAVGGVKRLWGIVNFILSFCLFMTILITKMAESHRRFATVGGGATVPLPPPGDVKAGALALFAVMGVPQAITYSIPFALASIFCNTAGAGQGLSLGVLNLSIVIPQMVVSVASGPWDALFGGGNLPAFVVGGVAAAASGIFAFTLLPSPQPDAPSAKTSRAVTAAFH

SEQ ID NO: 106 - protein, 498 aa, Hevea brasiliensis
MVASIAAGIQFGWALQLSLLTPYVQLLGIPHTWAAFIWLCGPISGMLVQPIVGYHSDRCTSRFGRRRPFIAGGALAVAVAVFLIGYAADLGQLSGDPVAKSPKPRAIAVFVVGFWILDVANNMLQGPCRALLADLSGANQKKTRIANALYSFFMAVGNVLGFAAGSYTHLYKIFPFTKTKACDVYCANLKSCFFISIVLLLTLTVLALIYVREKPWSPERGNTAAGDEEEEDEGASESSPMPFFSEIFASLKNLQKPMWILLLVTCLNWVAWFPFLLFDTDWMGREVYGGDSNGNPDQVRLYDRGVRAGALGLMLNSVVLGFTSLGVEVLARAVGGVKRLWGIVNFILSFCLFMTILITKMAESHRRFATVGGGATVPLPPPGDVKAGALALFAVMGVPQAITYSIPFALASIFCNTAGAGQGLSLGVLNLSIVIPQMVVSVASGPWDALFGGGNLPAFVVGGVAAAASGIFAFTLLPSPQPDAPSAKTSRAVTAAFH

SEQ ID NO: 107 - protein, 533 aa, Ricinus communis
MQSSTSKENKQPPSSQPHPPPLMVAGAAEPNSSPLRKVVMVASIAAGIQFGWALQLSLLTPYVQLLGIPHTWAAFIWLCGPISGMLVQPIVGYHSDRCTSRFGRRRPFIASGAAFVAIAVFLIGYAADLGHLSGDSLDKSPKTRAIAIFVVGFWILDVANNMLQGPCRALLADLSGTSQKKTRTANALFSFFMAVGNVLGYAAGAYTHLYKLFPFTKTTACDVYCANLKSCFFISIVLLLSLTVLALSYVKEKPWSPDQAVDNAEDDTASQASSSAQPMPFFGEILGAFKNLKRPMWILLLVTCLNWIAWFPFLLFDTDWMGREVYGGDSSGSAEQLKLYDRGVRAGALGLMLNSVVLGFTSLGVEVLARGVGGVKRLWGIVNFVLAVCLAMTVLVTKQAESTRRFATVSGGAKVPLPPPSGVKAGALALFAVMGVPQAITYSIPFALASIFSNTSGAGQGLSLGVLNLSIVIPQMIVSVAAGPWDALFGGGNLPAFVVGAVAALASGIFALTMLPSPQPDMPSAKALTAAFH

SEQ ID NO: 108 - protein, 534 aa, Populus tremula x Populus tremuloides
MESGVRKENNPPSSSFSLQQQPPATNPSPLRKIIVVASIAAGVQFGWALQLPLLTPYVQLLGIPHTWAAFIWLCGPISGMLVQPTVGYYSDRCTSRFGRRRPFIAAGAGFVAISVFLIGYAADIGHLSGDSLTKTAKPRAIAVFVVGFWILDVANNMLQGPCRAFLADLSGKDHKKTRTANAFYSFFMAVGNVLGFASGSYTHLYRIFPFSRTKACDVYCANLKSCFFISIALLLTLTILALSYVREKPWSPEGSSGEGGNEEEKEEEGGEAKESTPAPFFGEIVAALKNLQRPMRILLLVTCLNWIAWFPFLLFDTDWMGREVYGGDSSRNTDQLKMYDRGVRAGALGLLLNSVVLGFTSLGVEVLARGVGGVKRLWGIVNFILAICLAMTILITKVAQSNRRYTTVNGGTHLLPPPSGVKAGALALFAVMGIPQAITYSIPFALASIFSNTSGAGQGLSLGVLNLSIVISQMEVSVAAGSWDALFGGGNLPAFVVRAVAAAASGILAFTMLPSPAPDIPSNKRAATSTLAFI

SEQ ID NO: 109 - protein, 530 aa, Euphorbia esula
METQLATKNPSSQPPPPPPELAAPPSSNLKKIVVVASIAAGVQFGWALQLSLLTPYVQLLGIPHTWAAFIWLCGPISGMLVQPIVGYHSDRCTSRFGRRRPFIAAGAASVAVAVFLIGYAADLGHMSGDSIGKSPKIRAIAIFVVGFWILDVANNMLQGPCRALLADLSGTSQKKTRLANALFSFFMAVGNILGYAAGAYTHLYKIAPFTLTKACDVYCANLKTCFFISIALLLVLTVIALTYVKEKQWSPEIAKTVAGVDGDDEDGPVEAAPLPFFGEIFAALKNLQRPMRILLLVTCLNWIAWFPFLLFDTDWMGREVYGGSSDSSATAGESKLYDRGVRAGALGLMLNSVVLGFTSLGVELMARKLGKVKRLWGIVNFLLAICLALTILITKLAESGRHYPTVNGVVSTTPSPPSSGIKAGALTLFAVMGIPQAITYSVPFALASIFSNDSGAGQGLSLGVLNLSIVIPQMLVSVASGPFDALFGGGNLPAFVVGAVAAAASGVLALTYLPSPPPDLPAKALTVGFH

SEQ ID NO: 110 - protein, 512 aa, Heliothis virescens
MESAMKSDKQPPRAPLQLQHHELPQRPIWQIIMVAAIAAGVQFGWALQLSLLTPYVQLIGVPHTWSSFIWLCGPISGLIVQPVVGYYSDRCTSRFGRRRPFIAGGAMLVAIAVFLIGYAADIGVSTGDKIGAPSKPRAIAIFVIGFWILDVANNTLQGPCRALLADLAGSNSSKIRTGNAMFAFFMGVGNVLGYSAGSYTHLYRIVPFTKTDACDVYCANLKTCFFISIALLVSITVLALSTVSEDPFVPEPVDDSKSTGKQLVFFGEMFGALKELSRPMWILLLVTCLNWIAWFPFLLYDTDWMGKEVYGGKVGEQLYNRGVRAGALGLMLNSVVSGLASLCIEHLARWIGGVKRLWGGVNFLLAVCLAMTVLVTKMAESERVFVTGADGTVTPRSPSSGVVGGALTIFAVLGAPLAVTFSVPCALASIFCNNSGAGQGLSLGVLNLAIVIPQMVVSVLSGPWDALFGGGNLPAFVVGAVAAAASGIFALTMLPSPPPDVVLSKVSGGGMH

SEQ ID NO: 111 - protein, 513 aa, Vernonia mesipifolia
MESAVKNDKNQSGSALELQHPDATSQRPIWQLIMVAAIAAGVQFGWALQLSLLTPYVQLLGIPHTWSSFIWLCGPVSGMIVQPVVGYYSDRCTSRFGRRRPFIAGGALLVAVAVFLIGYAADIGVSTGDKLGAKTKPRAVGIFVVGFWILDVANNTLQGPCRALLADLAGSNSSKIRTGNAMFAFFMGVGNVLGYAAGSYTHLYEIVPFTKTKACDVYCANLKTCFFIAITLLVGITVLALATVSEDVYVPEADDDQKSGGKQVVFFGEMVGALKELSRPMWILLLVTCLNWVAWFPFLLFDTDWMGKEVYGGKVGEPLYNSGVRAGAMGLLLNSVVSGLSSLCIEHLARWLGGVKRLWGGINFLLAVCLAMTVVVTKMADSERQFKTLPDGSKTALPPGGDIKAGALSIFAVLGAPLAVTFSVPCALASIFSNSSGAGQGLSLGVLNLAIVIPQMFVSVLSGPWDALFGGGNLPAFVVGAISAAVSGILSFTMLPSPPPDVVLSKVSGGGMH

SEQ ID NO: 112 - protein, 505 aa, Vitis vinifera
MELAKPSSVFAIQDHQSSSPPTPIWKTVVVASIAAGIQFGWALQLSLLTPYVQLLGIPHKWAAFIWLCGPISGMIVQPVVGYHSDRCTSRFGRRRPFIAAGAVLVAIAVFLIGYAADIGRVSGDPLHNTIKTRAVAVFVVGFWILDVANNMLQGPCRALLADLSGTSARRTRTANALYSFFMAVGNVLGYAAGSFSKLHKMFPFARTQACDLYCANLKSCFFLSIALLLILTIIAFATVHETPLNRADIAVVEAGQPFYSQMMNAFRQLRRPMWVLLLVTCLNWIGWFPFLLFDTDWMGREVYGGTVGEGPRGRLYDLGVRAGSLGLMLNSVVLGLMSLGVEFFGRGVGGVKRLWGGVNFLLALCLALTVLVSKLAASWRHSLGGELHPPPIGIKAGALSLFAVMGVPLAITYSIPFALASIFCHSSGAGQGLSLGVLNLAIVVPQMMVSVASGPWDARFGGGNLPAFVVGAFAAALNGVLALTMLPAPPPDVPNTKDERTQPSS

SEQ ID NO: 113 - protein, 502 aa, Alonsoa meridionalis
MEVGNEAKSTALPPAQAAPVKNIIVVAAIAAGVQFGWALQLSLLTPYVQLLGVPHVWAAFIWLCGPISGLLVQPIVGYYSDNCTSRFGRRRPFIAAGAGLVAVAVFLIGFAADLGHMGGDSLGKGTKPRAVAVFVVGFWILDVANNMLQGPCRALLADMSAGNAKKMSSANSMFSFFMAVGNVLGYAAGSYTRLYKVFPFSKTEACAVYCANLKSCFFISVALLLTVTIIALCIVRETPYTAPPEEAGTVKKHTVPVFGELFGALKDLPRPMWMLLLVTALNWVAWFPFLLFDTDWMGKEVYGGKVGEGSLYDKGVRVGALGLMLNSVVLGVASLGVQVTARGLGGVKRLWGSVNLLLAICLAMTVLITKMAQHHREYASVGGAAPTLQPPVHGVKIGALALFSVLGIPLAATFSIPFALASIYSSNSGAGQGLSLGVLNLAIVIPQMFVSVASGPWDALFGGGNLPAFVVGAVAATVSGIIALTALPSPPSDVKILATGGH

SEQ ID NO: 114 - protein, 510 aa, Asarina barclaiana
MENGDHRTAPAFQLQQASPPEAAPVRNIILVAAIAAGVQFGWALQLSLLTPYVQLLGIPHTWTAFIWLCGPVSGMLVQPIVGYYSDNCTLRFGRRKPFIAGGAGLVVVAVFLIGFAADIGYAAGDTLGKGTKPRATAVFVVGFWILDVANNMLQGPCRALLADLSGGNARKMSNANALYSFFMAVGNVSGYAAGSYTHLFKIFPFSKTKACDVYCANLKSCFFISVALLLCVSALALTIVRETPPPETAEAPEATKKKKIPVFGELFSALKNLPRPMWFLLLVACLNWIAWFPFLLFDTDWMGKEVYGGTVAEGKMYDRGVRAGALGLMLNPVVLGFSSLGIQAIARGVGGPKRLWGGVNFLLAVCLALTVVITKQAEHSRLYTVGADGVQILLPPVPGVKISALALSGVLGIPLAVTFSIPFALASIYSSNYGAGQGLSLGVLNLAIVIPQMVVSVASGPLDALFGGGNIPAFVMGAVAAAVSGIFAVTMLPALPADASTKNLSVGSFH

SEQ ID NO: 115 - protein, 507 aa, Nicotiana tabacum
MENGTKKLNVSSLAVEQPLPKSKLWKIIMVASIAAGVQFGWALQLSLLTPYVQLLGIPHKFASFIWLCGPISGMIVQPVVGYYSDNCSSRFGRRRGFIAAGAALVTIAVFLIGFAADLGHATGDPLGKGSKPRAIAVFVVGFWILDVANNMLQGPCRALLADLSGGKARMRTSNAFFSFFMAVGNVLGYAAGSYSRLCKIFPFSKTPACDIYCANLKSCFFIAVFLLLSLTILALTVVRENELPEKDEHEIDEKAGARKSKVPFFGEIFGALKDLPRPMWILLLVTSLNWIARFPFFLYDTDWMAKEVYGGKVGDGRLYDLGVHAGALGLLLNSVVLGFMSLSVEFLGKKIGGVKRLWGILNFVLAVCMALTVLVTKMAEKSRQYDAHGTLMAPTSGVKIGALTLFAVLGIPLAVTFSVPFALASIFSSNAGSGQGLSLGVLNLAIVVPQMLVSIAGGPWDDLFGGGNLPGFIVGAVAAAASGILALTMLPSPPADAKPATTMGGFH

SEQ ID NO: 116 - protein, 516 aa, Solanum tuberosum
MENGTKREGLGKLTVSSSLQVEQPLAPSKLWKIIVVASIAAGVQFGWALQLSLLTPYVQLLGIPHKFASFIWLCGPISGMIVQPVVGYYSDNCSSRFGRRRPFIAAGAALVMIAVFLIGFAADLGHASGDTLGKGFKPRAIAVFVVGFWILDVANNMLQGPCRALLADLSGGKSGRMRTANAFFSFFMAVGNILGYAAGSYSHLFKVFPFSKTKACDMYCANLKSCFFIAIFLLLSLTTIALTLVRENELPEKDEQEIDEKLAGAGKSKVPFFGEIFGALKELPRPMWILLLVTCLNWIAWFPFFLYDTDWMAKEVFGGQVGDARLYDLGVRAGAMGLLLQSVVLGFMSLGVEFLGKKIGGAKRLWGILNFVLAICLAMTILVTKMAEKSRQHDPAGTLMGPTPGVKIGALLLFAALGIPLAATFSIPFALASIFSSNRGSGQGLSLGVLNLAIVVPQMLVSLVGGPWDDLFGGGNLPGFVVGAVAAAASAVLALTMLPSPPADAKPAVAMGLSIK

SEQ ID NO: 117 - protein, 512 aa, Apium graveolens
MENGTKELNKQPPPSAAMQVQTSPPKLPIATWKLILVAAIAAGVQFGWALQLSLLTPYVQLLGIPHKWAAYIWLCGPISGMLVQPIVGYYSDRCQSSFGRRRPFIASGAGCVAISVILIGFAADIGYKAGDDMTKTLKPRAVTGFVIGFWILDVANNMLQGPCRALLADLCNGDTRRMRSANAFYSFFMAVGNILGYAAGSYNNLYKLFPFSKTHACDLYCANLKSCFIISIVLLIFITVLALTVVREKQWSPDEADEEPPSSGKIPVFGELFGALKDLPRPMLMLLVVTCLNWIAWFPFILFDTDWMGREIYGGTAGQGKLYDQGVRVGSLGLLLNSVVLGLTSIAVEYLVRGVGGVKILWGLVNFLLAIGLVMTVVVSKVAQHQRQHGANGQLLPPSAGVKAGALSLFSILGIPLSITFSIPFALASIYSSGSGAGQGLSLGVLNLAIVVPQMIVSVLAGPFDSLFGGGNLPAFVVGAISAAISGVLAIVLLPKPSKDAAAKLTLSGPYH

SEQ ID NO: 118 - protein, 512 aa, Apium graveolens
MENGTKELNKQPPPSAAMQVQTSPPKLPIATWKLILVAAIAAGVQFGWALQLSLLTPYVQLLGIPHKWAAYIWLCGPISGMLVQPIVGYYSDRCQSSFGRRRPFIASGAGCVAISVILIGFAADIGYKAGDDMNKTLKPRAVTVFVIGFWILDVANNMLQGPCRALLADLCNGDTRRMRSANALYRFFMAVGNILGNAAGSYNNLYKLFPFSKTHACDLYCANLKSCFIISIVLLIFITVLALTVVREKQWSPDEADEEPPSSGKIPVFGELLRALKDLPRPMLMLLAVTCLNWIAWFPFILFDTDWMGREIYGGTAGQGKLYDQGVRVGSLGLLLNSVVLGLTSIAVEYLVRGVGGVKILWGLVNFLLAIGLVMTVVVSKVAQHQRQHGANGQLLPPSAGVKAGALSLFSILGIPLSITFSIPFALASIYSSGSGAGQGLSLGVLNLAIVVPQMIVSVLAGPFDSLFGGGNLPAFVVGAISAAISGVLAIVLLPKPCKDAAAKLTLSGPYH

SEQ ID NO: 119 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADISYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVRENSGPPDDADAAEEPPSSGKIPVFGELLGALKDLPRPMLLLLIVTCLNWIAWFPFILFDTDWMGREIYGGTAGQGKLYDQGVRAGALGLLLNSVVLGLTSIAVEYLVRGVGGVKILWGFVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 120 - protein, 539 aa, Beta vulgaris
MEGRNVKNGDTNNNKIVGSSLSIEKNPISPPEASSLKKLALVASIAAGVQFGWALQLSLLTPYVQLLGIPHTWAPYIWLCGPISGMIVQPTVGYYSDRCTSKFGRRSPFIAVGATLVGFAVSLIGFAADIGHATGDPNGNVPKPRAIAVFVVGFWILDVANNTLQGPCRALLADMAAGSQAKTRYANAFFSFFMALGNIGGYAAGSYSRLYTVFPFTHTKACDTYCANLKSCFFISITLLIVLTILALSVVRERPFTLDEIQEEENLKNNTGGCARLPFFGQLFGALKDLPKPMLILLLVTCLNWIAWFPFLLFDTDWMGKEVYGGTVGEGKAYDMGVHAGALGLMINSVVLGIMSLGIEKLARLVGGVKRLWGIVNLILAVCLAMTILVTKSAEHYRATHHVPGAIGPPLPPPGFKGGALAIFSVLGIPLAITFSIPFALASIFSASSGSGQGLSLGVLNLAIVVPQMFVSVTSGPWDALFGGGNLPAFVVGAVAATASAILSFTLLPSPHRKPKSEGQWVAIKNKEAVLIFNFLFFI

SEQ ID NO: 121 - protein, 525 aa, Spinacia oleracea
MAGRNIKNGENNKIAGSSLHLEKNPTTPPEAEATLKKLGLVASVAAGVQFGWALQLSLLTPYVQLLGIPHTWAAYIWLCGPISGMIVQPLVGYYSDRCTSRFGRRRPFIAAGAALVAVAVGLIGFAADIGAASGDPTGNVAKPRAIAVFVVGFWILDVANNTLQGPCRALLADMAAGSQTKTRYANAFFSFFMALGNIGGYAAGSYSRLYTVFPFTKTAACDVYCANLKSCFFISITLLIVLTILALSVVKERQITIDEIQEEEDLKNRNNSSGCARLPFFGQLIGALKDLPKPMLILLLVTALNWIAWFPFLLFDTDWMGKEVYGGTVGEGKLYDQGVHAGALGLMINSVVLGVMSLSIEGLARMVGGAKRLWGIVNIILAVCLAMTVLVTKSAEHFRDSHHIMGSAVPPPPPAGVKGGALAIFAVLGIPLAITFSIPFALASIFSASSGSGQGLSLGVLNLAIVVPQMFVSVTSGPWDAMFGGGNLPAFVVGAVAATASAVLSFTLLPSPPPEAKIGGSMGGH

SEQ ID NO: 122 - protein, 528 aa, Citrus sinensis
MESTEAGAAAAAPTKNQSSIELRQPPPPPSSPMWKIVMVASIAAGVQFGWALQLSLLTPYVQLLGIPHKWSSLIWLCGPISGMIVQPIVGFHSDTCKSRFGRRRPFILAGAVLVAIAVFLIGYAADIGHSAGDSVTDSVKTRAIIIFVIGFWILDVANNTLQGPCRALADLSSGSSNKKTRTANSFFSFFMAVGNVLGYAAGSYTHLYHMLPFTKSKACDVYCANLKTCFFLSIALLITLTTIALFYVTEQRLEEIDDKETAPSTKDPFFSEIFGALKGLQKPMWILLAVTALNWIAWFPFLLFDTDWMGREVYGGNSKGSAEELRVYNNGVRAGSLGLMLNAIVLGFTSLGVEVLAKLIGGVKRLWGVVNFLLAVSLAFTFLITKLAESNRRSVTTAGGATHILPPPVGVKVGALAIFTVLGIPQAITFSVPFAMASIFSRTSAAGQGLSLGVLNLAIVVPQMLVSLLSGPFDAVCGGGNMPAFMVGAVAAALSGIVALTLLPSTTADVPPPITEAGTATANQTNKL

SEQ ID NO: 123 - protein, 508 aa, Brassica oleracea
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLLLVTFMSLCYVTEKPWTPEPTADGKPSSVPFFGEIFGAFKELKRPMWMLLIVTALNWIAWFPFLLFDTDWMGREVYGGNSDATASVASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 124 - protein, 513 aa, Brassica oleracea
MGAFETENTAKDAAALETQSSLEEFNQPSPLRKIISVSSIAAGVQFGWALQLSLLTPYVQLLGIPHKWSSLIWLCGPVSGMIVQPIVGFHSDRCTSRFGRRRPFIAAGAAMVAVAVFLIGYAADIGYKMGDKLEQTPRVRAIGIFALGFWILDVANNTLQGPCRAFLADLAAGDAKRTRVANAFFSFFMAVGNVLGYAAGSFTNLHKMFPFAMTNACDLYCANLKSCFFLSITLLLIVTVTSLWYVKDKQWSPPPVAADEEKKSVPFFGEIFGAFKVMERPMWMLLIVTALNWIAWFPFLLFDTDWMGREVYGGDSEGDARLKQIYNKGVQSGALGLMFNSIVLGFMSLGVEWIGKKVGGAKRLWGIVNFILAIGLAMTVLVTKLAADYRKVAGPYAGPSPGIRAGALSLFAVLGIPLAITFSIPFALASIFSSSSGAGQGLSLGVLNLAIVIPQMIVSLGGGPFDALFGGGNLPAFIVGAIAAAISGVLAITVLPSPPPDAPALKTGAMGFH

SEQ ID NO: 125 - protein, 503 aa, Plantago major
MGELSGIENGNKAIGEEAIPVWKFVLVASLAAGIQFGWALQLSLLTPYIQMLGLPHGAASFIWLCGPVSGLLVQPLAGYFSDRCKSRFGRRRPFIMSGACLVAAAVILIGFAADIGHSAGDDMTKKTKPRAVVVFVVGFWILDVANNMLQGPCRAFLADLSAGDEKKMTHAMSFFAFFMGIGNVLGYAAGSYNNLHRLLPFTRTDACEIFCANLKTCFLIHICLLMCLTITALSVVKEPLVNVVDDERKGGSLMVFVELFGALKNLSKPMWILMLVTCLNWIAWFPFLLYDTDWMGREVYGGKVNQSVYDMGVRAGAIGLMLNSVVLGITSILLYFFSKGAKAAKTWWLGVNIVLAVGLAGTVWVSYHAKSVRQLGASGEALPPSFEVKASALAIFAILGIPLAVTFSVPFALAAIYCSRNTNTGGAGQGLSLGVMNLSIVIPQIIVSLSSGPLDKAFGGGNLPAFIMGAVGAVFSGVLAFILLPAPKVDNGVNPFAVGGGGH

SEQ ID NO: 126 - protein, 521 aa, NIcotiana tabacum
MESGSMEMKVQQPYLAVPVLPPRWKIVMVASIAAGVQFGWALQLSLLTPYLQLLGIPHRYASIIWLCGPISGMIVQPAVGYLSDNLSSTFGRRRPFIAAGSSLVAVAVIFIGFAADIGHAFGDPLDTKTKPLGIITFIVGFWYLDVANNMLQGPCRAFLADLSGGKACRIRTGQSCYAFFMAVGSILGNAAGSYSHLYTIFPFTKTEACGVQCANLKSCFLISVVLLLTLTTLALTAVDEKVLPQKDHFINSEYLGSSGKKGGLLFFGEMFEALKHLPRSVWILLMVTAVNWIAWFPFTLYGTDWMGKEVYGGRVRDGNLYNKGVHAGVFGLLLSSVVLCLMSLGVECVGKWLGGAKRLWGIVNFILAICLAMTVFVTKMADKSRRYDGDGELLPPDQGVKISALLLNAVTGIPLAVLYSIPFAMASIYSSNVGAGQGLSQGVINLAIVVPQTLVSISGRPFDALFGGGNLPAFVAGAVAAAVSGILALTLLPSPTEPCQTYPHFRRCFPMTKYWTSQNKF

SEQ ID NO: 127 - DNA, 1581 bp, Yarrowia lipolytica
atggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtag

SEQ ID NO: 128 - DNA, 8756 bp, artificial sequence
  YL DGAT1-pKR345 clone
gatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacg

SEQ ID NO: 129 - DNA, 8720 bp, artificial sequence
  YLDGAT1 clone
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagc

SEQ ID NO: 130 - DNA, 4906 bp, artificial sequence
  vector DNA
ggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagc

SEQ ID NO: 131 - DNA, 11625 bp, artificial sequence
  AtSUC2HIS6 DGAT1 35Hyg clone
ggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaaaaaccatggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcatcaccaccatcaccattgagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcaggatctggccggccggatctcgtacggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgca

SEQ ID NO: 132 - DNA, 3877 bp, artificial sequence
  ann-myb2 term sbf
gtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcagggcatgcaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagctt

SEQ ID NO: 133 - DNA, 5446 bp, artificial sequence
  ann-AtSUC2 clone
gtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaaaaaccatggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcatcaccaccatcaccattgagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcagggcatgcaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagctt

SEQ ID NO: 134 - DNA, 11622 bp, artificial sequence
  AtSUT4HIS6DGAT1 35Hyg clone
ggatctggccggccggatctcgtacggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaaaaaccatggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttacgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccacatcaccaccatcaccattgagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgca

SEQ ID NO: 135 - DNA, 5443 bp, artificial sequence
  ann AtSUT4 clone
gtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaaaaaccatggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttacgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccacatcaccaccatcaccattgagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcagggcatgcaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagctt

SEQ ID NO: 136 - DNA, 11889 bp, artificial sequence
  AtSUT2HIS6 DGAT1 35Hyg clone
ggatctggccggccggatctcgtacggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaaaaaccatgagtgactcggtgtcgatctcggttccgtataggaatttgaggaaggaaattgaacttgagacggtcaccaagcatcgtcaaaacgaatctggttcttcgtcgttctctgaatctgcttctccttcgaatcattctgattcggctgatggtgaatctgtgtcgaagaattgtagtttagtgacgttggttcttagttgtacagttgccgctggagttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggccatcaccaccatcaccattaagcgaagggcgaattcgcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgca

SEQ ID NO: 137 - DNA, 5710 bp, artificial sequence
  ann-AtSUT2 clone
gtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaaaaaccatgagtgactcggtgtcgatctcggttccgtataggaatttgaggaaggaaattgaacttgagacggtcaccaagcatcgtcaaaacgaatctggttcttcgtcgttctctgaatctgcttctccttcgaatcattctgattcggctgatggtgaatctgtgtcgaagaattgtagtttagtgacgttggttcttagttgtacagttgccgctggagttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggccatcaccaccatcaccattaagcgaagggcgaattcgcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcagggcatgcaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagctt

SEQ ID NO: 138 - DNA, 6822 bp, artificial sequence
  plasmid with soybean selection marker
ggtcgactcgacgtacgtctagaggatcaaacaccggtgttaattaggtaatttcaccgcgtctagtgagctcggtacccgggtaccggcgcgcccgagcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccggtaccgggccccccctcgagtggcgttagctgattaagtcagcatgcgcggccggccgcaagctctagtgaagttcctatactttctggagaataggaacttcggaataggaacttcaccgggatcatcagctgggccggcccagctgatgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggtggaagttcctatactttctagagaataggaacttcggaataggaacttctgttgttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttgggaagggcgaattccagcacactggcggccgttactagtgtttagcttactagagtcgacctgca

SEQ ID NO: 139 - DNA, 9688 bp, artificial sequence
  Plasmid derived form RTW212
gtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaaaaaccatggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttacgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccacatcaccaccatcaccattgagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcaggtcgactcgacgtacgtctagaggatcaaacaccggtgttaattaggtaatttcaccgcgtctagtgagctcggtacccgggtaccggcgcgcccgagcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccggtaccgggccccccctcgagtggcgttagctgattaagtcagcatgcgcggccggccgcaagctctagtgaagttcctatactttctggagaataggaacttcggaataggaacttcaccgggatcatcagctgggccggcccagctgatgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggtggaagttcctatactttctagagaataggaacttcggaataggaacttctgttgttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttgggaagggcgaattccagcacactggcggccgttactagtgtttagcttactagagtcgacctgcaggagatccaagctt

SEQ ID NO: 140 - DNA, 13088 bp, artificial sequence
  ATSUT4 DGAT1 ALS clone
gtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaaaaaccatggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttacgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccacatcaccaccatcaccattgagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcaggtcgactcgacgtacggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgagggtaccggcgcgcccgagcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccggtaccgggccccccctcgagtggcgttagctgattaagtcagcatgcgcggccggccgcaagctctagtgaagttcctatactttctggagaataggaacttcggaataggaacttcaccgggatcatcagctgggccggcccagctgatgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggtggaagttcctatactttctagagaataggaacttcggaataggaacttctgttgttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttgggaagggcgaattccagcacactggcggccgttactagtgtttagcttactagagtcgacctgcaggagatccaagctt

SEQ ID NO: 141 - DNA, 33 bp, Artificial Sequence
  Glyma08g40980 primer
agcggccgcaccatgatgacggggaagtctgac

SEQ ID NO: 142 - DNA, 29 bp, Artificial Sequence
  Glyma08g40980 primer
agcggccgcctagccaatatgaaaacctg

SEQ ID NO: 143 - DNA, 31 bp, Artificial Sequence
  Glyma18g15950 primer
agcggccgcaccatgacgacggggaagtctg

SEQ ID NO: 144 - DNA, 34 bp, Artificial Sequence
  Glyma18g15950 primer
agcggccgcctagccaatatgaaatcctgttgac

SEQ ID NO: 145 - DNA, 30 bp, Artificial Sequence
  Glyma02g38300 primer
gcggccgcatgccgaatcccgaggctcacc

SEQ ID NO: 146 - DNA, 35 bp, Artificial Sequence
  Glyma02g38300 primer
gcggccgctcatacatggcttcgagccttttgagc

SEQ ID NO: 147 - DNA, 30 bp, Artificial Sequence
  Glyma04g09460 primer
gcggccgcatggcgaatcacgaaacccaac

SEQ ID NO: 148 - DNA, 35 bp, Artificial Sequence
  Glyma04g09460 primer
gcggccgctcatacagggcttcgaggcttttgacc

SEQ ID NO: 149 - DNA, 2040 bp, Paspalum notatum
cgcggccgaccccgcggcctccatcagcctcggcaggctcatcctcgccggcatggtcgccggcggcgtgcagtacggctgggcgctgcagctctccctcctcacgccctacgtgcagaccctggggctttcgcatgcacttacttcattcatgtggctatgtggtcctattgctggtttagtggttcaaccgtgcgttggcctatacagtgacaggtgtaggtcaaaatggggaagacggaggccatttatcctgacaggatgtgcgctcatctgtattgctgtcgtggttgtcggtttttcttcagacatagggtctgctctaggcgacacaaaggaagattgcagtctctaccatggtcctcgctggcatgctgcaattgtgtatgtgctggggttttggctccttgacttctccaacaatactgtgcagggtccagctcgtgctctgatggctgatttgtcaggtcatcatggccctagtgcagctaattcaatcttctgttcttggatggcgctgggaaatatcctgggttattcctctggttccacaagcaagtggcaccagtggtttcccttccttaaaacaaaagcctgttgtgaagcctgtgcaaacctgaaaggtgcatttctggtggctgtggttttcctgatcatttgcttgactgtgtccctgatcttcgccaaggaaataccgtacagaggaacagagaacctcccaacaaaagcaaacggcgaggtcgaaccagaaagtaccgggccgcttgctgtgttcaagggcttcaagaacttgccccgtgggatgccgtccgtgcttctcgtaactggactcacctggctctcgtggttcccgttcatcctctacgacacggactggatgggtcgtgagatctaccacggtgacccaaaggggaccaatgctcaggttgcggcgttcgacgaaggtgtcagagttggtgccttcgggctgctgctcaactcgatcgttctggggttgacgtccttcctgatcgagccgatgtgccggaaggtggggccgaggctggtgtgggtgacgagcaacgtgatggtctgcatcgccatggcggcgaccgcgctgatcagcttctggtcgctcaaggacttccacggatacgtgcaggacgccatcaccgcgagcccgagcatcaaggccgtgtgcctgctcctcttcgccttcctcggtgtccctctcgcgatcctgtacagcgtcccgttcgccgtgacggcgcagctggcggccagcaaaggcggcgggcaagggctctgcaccggcgtcctgaacatctccattgtcatcccgcaggtgatcatcgcgctgggcgcggggccgtgggacgccctgttcggcaaggggaacatcccggcgttcggcgtggcgtccgggttcgccctcatcggcggcatcgcgggcgtgttcctgctgcccaagatctcgaagcgccagttccgggccgtcagcgccggcggccactgagcccgggcccggccttgcgaggccagggcatggccgccttgcaagagacagtttttatgttgaacagagtgaataagcgagtgtctgaaacaaacaaagccgtgtgtacttactccatgttgatgtgtgcgagtgcgatagtaggcgtgtgggcaagtgaaccgaagtgaggcgaggtcatggtcgtgagcatccagcaccagccggtaccaaggtctggtctctgctagctagctagtgtaaggaggagcgagtaggtcagttaaggctggtgcgtcgtgagggctcgatctgtcgacccggtatagtcaccatggtgttggtggtgttgtcgtctccatgtcttttgtgtgtagcacagcacagcagacctgatcaggggcaaaaaggggattgtattggatcaatcaatgtgcagtactatactagttgatgattggtctagcagagcttctagagggctactactcctactgctatgtatggtccgccctccgccgtttaagatttttgggtccgagcaaatgcaggcgccttgttttgct

SEQ ID NO: 150 - protein, 497 aa, Paspalum notatum
AADPAASISLGRLILAGMVAGGVQYGWALQLSLLTPYVQTLGLSHALTSFMWLCGPIAGLVVQPCVGLYSDRCRSKWGRRRPFILTGCALICIAVVVVGFSSDIGSALGDTKEDCSLYHGPRWHAAIVYVLGFWLLDFSNNTVQGPARALMADLSGHHGPSAANSIFCSWMALGNILGYSSGSTSKWHQWFPFLKTKACCEACANLKGAFLVAVVFLIICLTVSLIFAKEIPYRGTENLPTKANGEVEPESTGPLAVFKGFKNLPRGMPSVLLVTGLTWLSWFPFILYDTDWMGREIYHGDPKGTNAQVAAFDEGVRVGAFGLLLNSIVLGLTSFLIEPMCRKVGPRLVWVTSNVMVCIAMAATALISFWSLKDFHGYVQDAITASPSIKAVCLLLFAFLGVPLAILYSVPFAVTAQLAASKGGGQGLCTGVLNISIVIPQVIIALGAGPWDALFGKGNIPAFGVASGFALIGGIAGVFLLPKISKRQFRAVSAGGH

SEQ ID NO: 151 - DNA, 4550 bp, Artificial Sequence
  Glyma02g38300 in pGEM-T Easy
gggcgaattgggcccgacgtcgcatgctcccggccgccatggcggccgcgggaattcgattgcggccgcatgccgaatcccgaggctcaccacccctcccggtcccgggcccggccctccacgtcagccgcggcccgccccccggcccgggcccgcgtctccctccgccagcttctgcgcgtggcatcagtcgcgagcggcatccagttcgggtgggccttacagctctctctgctgacgccctacgttcagcagctggggatcccccaccaatgggccagcatcatctggctctgcggcccagtctccggcctcttcgtgcagcccctcgtcggccacatgagcgaccgctgcaccagccgctacggccgccgcaggcccttcatcctcgtcggcgccgtcgccatcgtcgccgctgttctcgtcatcgcttacgccgccgacatcggctggctcctcggcgacaccgcggactaccgccctgccgccatcaccgtcttcatcgtcggcttctggatcctcgacgtcgctaacaacgtcacgcaaggtccctgccgtgccttgctcggtgatctcactagcaaggatcctcgaaggacacgtgttgcaaatgcttattactcactgtttatggccattggtaacattcttggctatgcaactggatcatatagtggttggtacaagatttttacttttgccctttcccctgcttgcacaattagttgtgcaaatctcaagtctgctttctttcttgacattgctttcattgcggtcacaacatatatcagcatcatggcagctcatgaagtgcctctaaattcaagtgaggcggcccatgctgaagcaggggcaggggagtcaggtagtgcagaagaagctttcatgtgggaattatttgggacattcaaatattttacaacccctgtatggataattctgtctgttactgctctgacatggattgggtggttcccatttactctctttgatactgattggatgggtcgagagatttatggtggtgatccaaatcaaggccttgtttatgatactggagttagaatgggagcacttggtttgttgcttaattcagttgttcttgcattaacatcattgttcatggagaggctatgcaggaagaggggagctggttttgtgtggggaatctcaaatatcatgatgaccgtttgctttcttgcaatgctagtagtaacctatgtggcaaataacatgggctatataggcaaagatttaccaccaactggcattgtgatagctgcgttgattatctttaccattcttgggtttccactggcaatcacttatagtgttccatatgccttaatttccacacatattgagtcattgggactcggccaagggttatcaatgggtgtcctaaatctggcaatagtggtcccacagataatagtgtcactgggaagtggaccatgggatcagctatttggtggaggaaactccccagcctttgctgtggcagctgtttcagcccttatcagtggactcatagctgtgttggctattcctcgatctggtgctcaaaaggctcgaagccatgtatgagcggccgcatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactata

SEQ ID NO: 152 - DNA, 5403 bp, Artificial Sequence
  pKR1680
ggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcagggcatgcaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcatgccgaatcccgaggctcaccacccctcccggtcccgggcccggccctccacgtcagccgcggcccgccccccggcccgggcccgcgtctccctccgccagcttctgcgcgtggcatcagtcgcgagcggcatccagttcgggtgggccttacagctctctctgctgacgccctacgttcagcagctggggatcccccaccaatgggccagcatcatctggctctgcggcccagtctccggcctcttcgtgcagcccctcgtcggccacatgagcgaccgctgcaccagccgctacggccgccgcaggcccttcatcctcgtcggcgccgtcgccatcgtcgccgctgttctcgtcatcgcttacgccgccgacatcggctggctcctcggcgacaccgcggactaccgccctgccgccatcaccgtcttcatcgtcggcttctggatcctcgacgtcgctaacaacgtcacgcaaggtccctgccgtgccttgctcggtgatctcactagcaaggatcctcgaaggacacgtgttgcaaatgcttattactcactgtttatggccattggtaacattcttggctatgcaactggatcatatagtggttggtacaagatttttacttttgccctttcccctgcttgcacaattagttgtgcaaatctcaagtctgctttctttcttgacattgctttcattgcggtcacaacatatatcagcatcatggcagctcatgaagtgcctctaaattcaagtgaggcggcccatgctgaagcaggggcaggggagtcaggtagtgcagaagaagctttcatgtgggaattatttgggacattcaaatattttacaacccctgtatggataattctgtctgttactgctctgacatggattgggtggttcccatttactctctttgatactgattggatgggtcgagagatttatggtggtgatccaaatcaaggccttgtttatgatactggagttagaatgggagcacttggtttgttgcttaattcagttgttcttgcattaacatcattgttcatggagaggctatgcaggaagaggggagctggttttgtgtggggaatctcaaatatcatgatgaccgtttgctttcttgcaatgctagtagtaacctatgtggcaaataacatgggctatataggcaaagatttaccaccaactggcattgtgatagctgcgttgattatctttaccattcttgggtttccactggcaatcacttatagtgttccatatgccttaatttccacacatattgagtcattgggactcggccaagggttatcaatgggtgtcctaaatctggcaatagtggtcccacagataatagtgtcactgggaagtggaccatgggatcagctatttggtggaggaaactccccagcctttgctgtggcagctgtttcagcccttatcagtggactcatagctgtgttggctattcctcgatctggtgctcaaaaggctcgaagccatgtatgagc

SEQ ID NO: 153 - DNA, 11582 bp, Artificial Sequence
  pKR1684
ggatctggccggccggatctcgtacggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcatgccgaatcccgaggctcaccacccctcccggtcccgggcccggccctccacgtcagccgcggcccgccccccggcccgggcccgcgtctccctccgccagcttctgcgcgtggcatcagtcgcgagcggcatccagttcgggtgggccttacagctctctctgctgacgccctacgttcagcagctggggatcccccaccaatgggccagcatcatctggctctgcggcccagtctccggcctcttcgtgcagcccctcgtcggccacatgagcgaccgctgcaccagccgctacggccgccgcaggcccttcatcctcgtcggcgccgtcgccatcgtcgccgctgttctcgtcatcgcttacgccgccgacatcggctggctcctcggcgacaccgcggactaccgccctgccgccatcaccgtcttcatcgtcggcttctggatcctcgacgtcgctaacaacgtcacgcaaggtccctgccgtgccttgctcggtgatctcactagcaaggatcctcgaaggacacgtgttgcaaatgcttattactcactgtttatggccattggtaacattcttggctatgcaactggatcatatagtggttggtacaagatttttacttttgccctttcccctgcttgcacaattagttgtgcaaatctcaagtctgctttctttcttgacattgctttcattgcggtcacaacatatatcagcatcatggcagctcatgaagtgcctctaaattcaagtgaggcggcccatgctgaagcaggggcaggggagtcaggtagtgcagaagaagctttcatgtgggaattatttgggacattcaaatattttacaacccctgtatggataattctgtctgttactgctctgacatggattgggtggttcccatttactctctttgatactgattggatgggtcgagagatttatggtggtgatccaaatcaaggccttgtttatgatactggagttagaatgggagcacttggtttgttgcttaattcagttgttcttgcattaacatcattgttcatggagaggctatgcaggaagaggggagctggttttgtgtggggaatctcaaatatcatgatgaccgtttgctttcttgcaatgctagtagtaacctatgtggcaaataacatgggctatataggcaaagatttaccaccaactggcattgtgatagctgcgttgattatctttaccattcttgggtttccactggcaatcacttatagtgttccatatgccttaatttccacacatattgagtcattgggactcggccaagggttatcaatgggtgtcctaaatctggcaatagtggtcccacagataatagtgtcactgggaagtggaccatgggatcagctatttggtggaggaaactccccagcctttgctgtggcagctgtttcagcccttatcagtggactcatagctgtgttggctattcctcgatctggtgctcaaaaggctcgaagccatgtatgagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgca

SEQ ID NO: 154 - DNA, 5343 bp, Artificial Sequence
  pLF235
cctgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacgcgttagaatactcaagctatgcatcaagcttggtaccgagctcggatccactagtaacggccgccagtgtgctggaattcaggagcggccgcctagccaatatgaaaacctgttgactggaatgaactgctagagagatctggcagtttgagagttgcaatgacagcaccggcaagagcacacacggaagccaaaacaaacgcagggatattgccaccaccaaagagagcatcccaaggaccagaaccaagggatataatcatctgaggaacaacaattgcaagatttagaactcctatagccaatccttggccacctcctgaatcagcagtcaactctgctgtgacggcaaagggaacactataggtaatcgcaagaggaaaaccaagaagaacaaacacaaccaaggaagccatcttgattccttcatttgctccaattatgtgttctatccctccagaataatctcttactgaaataagactaatgatagcagtgccagccatgcaaacaaagacgataaaattgctcagtgcccatactaattttgcacccatccacttacacattggttcaatgaagaaagagctaattccaaggacaacagaattcaatagcaaaccaaatgcaccttctctaactccttgatcataaagatctacttcagaagtgtccccttttggatcaccatgataaacttctctccccatccaatccgtatcaaacagaaagaagggaaaccaagacaaccaagtgagagccattacaaccaggactgaatgcatggcaggtggcaaatgccttaaacttgtcaacaagtttaccaataccgctccaggcccatccattacattttcagcatgatcttccccagctttgaaattcccatgcttcagctctgtatctttctcaatgtgattctcagttctcttactattggattcatccataacagataaaggctttaattttgaaaaatcaacaccattttgttgttgttcatccagtaaaggagaagaatctgacaagtgatgatgttgacttgcagtagtaagtggaacctcatcagcaaaatatagggtgacaagtgtgcataatgtcagaaacaccacagccacaagaaatgctgctttaagattgccacaggcttcacagcaagctctagttgtcaagaaaggaaaccatttgttccactttccactagcacctgaagaatatcctaggatgttcccaactgccatccacgagcaaaatatagcatttgcaacattgcgttgatcaggaccagacagatcagccaaaagtgctcgagctggcccctgcactgtgttgttagcaaggtccagcatccagaacccaagaataaatacaagagcagcccttgttcgggtccctttaaatgttctgcaatgctcatgtgtatcacctaatacatatccaatgtcagcagaaaatccgattaatatcacagccagacatatcataagagatcctgccagaatgaacggccgtcttctgccaaaccttgaagtacatttatcactccaaataccaacgcatggttgaaccacaagacctgtaatggggccacagagccaaataaacgaagaaaacgcatgtcctattcccaacgtctgaatgtagggcgtcaagagagagagctgcaaggcccagccgaattggacgccggcggcgacggtgcaactgagaacgagatgaagcaacggagcgttgatgttgttgttgttcggcggcgagggagagtgatttggcggtggcggtgatggtggcaagttgcggtggttgacgtcgacgagttcgagttcgggggcggaggaatcgtggtggagattcttgtagggaacgcggatcgacaacaagtcagacttccccgtcatcatggtgcggccgct

SEQ ID NO: 155 - DNA, 5697 bp, Artificial Sequence
  pKR1681
ggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcagggcatgcaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaccatgatgacggggaagtctgacttgttgtcgatccgcgttccctacaagaatctccaccacgattcctccgcccccgaactcgaactcgtcgacgtcaaccaccgcaacttgccaccatcaccgccaccgccaaatcactctccctcgccgccgaacaacaacaacatcaacgctccgttgcttcatctcgttctcagttgcaccgtcgccgccggcgtccaattcggctgggccttgcagctctctctcttgacgccctacattcagacgttgggaataggacatgcgttttcttcgtttatttggctctgtggccccattacaggtcttgtggttcaaccatgcgttggtatttggagtgataaatgtacttcaaggtttggcagaagacggccgttcattctggcaggatctcttatgatatgtctggctgtgatattaatcggattttctgctgacattggatatgtattaggtgatacacatgagcattgcagaacatttaaagggacccgaacaagggctgctcttgtatttattcttgggttctggatgctggaccttgctaacaacacagtgcaggggccagctcgagcacttttggctgatctgtctggtcctgatcaacgcaatgttgcaaatgctatattttgctcgtggatggcagttgggaacatcctaggatattcttcaggtgctagtggaaagtggaacaaatggtttcctttcttgacaactagagcttgctgtgaagcctgtggcaatcttaaagcagcatttcttgtggctgtggtgtttctgacattatgcacacttgtcaccctatattttgctgatgaggttccacttactactgcaagtcaacatcatcacttgtcagattcttctcctttactggatgaacaacaacaaaatggtgttgatttttcaaaattaaagcctttatctgttatggatgaatccaatagtaagagaactgagaatcacattgagaaagatacagagctgaagcatgggaatttcaaagctggggaagatcatgctgaaaatgtaatggatgggcctggagcggtattggtaaacttgttgacaagtttaaggcatttgccacctgccatgcattcagtcctggttgtaatggctctcacttggttgtcttggtttcccttctttctgtttgatacggattggatggggagagaagtttatcatggtgatccaaaaggggacacttctgaagtagatctttatgatcaaggagttagagaaggtgcatttggtttgctattgaattctgttgtccttggaattagctctttcttcattgaaccaatgtgtaagtggatgggtgcaaaattagtatgggcactgagcaattttatcgtctttgtttgcatggctggcactgctatcattagtcttatttcagtaagagattattctggagggatagaacacataattggagcaaatgaaggaatcaagatggcttccttggttgtgtttgttcttcttggttttcctcttgcgattacctatagtgttccctttgccgtcacagcagagttgactgctgattcaggaggtggccaaggattggctataggagttctaaatcttgcaattgttgttcctcagatgattatatcccttggttctggtccttgggatgctctctttggtggtggcaatatccctgcgtttgttttggcttccgtgtgtgctcttgccggtgctgtcattgcaactctcaaactgccagatctctctagcagttcattccagtcaacaggttttcatattggctaggc

SEQ ID NO: 156 - DNA, 11876 bp, Artificial Sequence
  pKR1685
ggatctggccggccggatctcgtacggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaccatgatgacggggaagtctgacttgttgtcgatccgcgttccctacaagaatctccaccacgattcctccgcccccgaactcgaactcgtcgacgtcaaccaccgcaacttgccaccatcaccgccaccgccaaatcactctccctcgccgccgaacaacaacaacatcaacgctccgttgcttcatctcgttctcagttgcaccgtcgccgccggcgtccaattcggctgggccttgcagctctctctcttgacgccctacattcagacgttgggaataggacatgcgttttcttcgtttatttggctctgtggccccattacaggtcttgtggttcaaccatgcgttggtatttggagtgataaatgtacttcaaggtttggcagaagacggccgttcattctggcaggatctcttatgatatgtctggctgtgatattaatcggattttctgctgacattggatatgtattaggtgatacacatgagcattgcagaacatttaaagggacccgaacaagggctgctcttgtatttattcttgggttctggatgctggaccttgctaacaacacagtgcaggggccagctcgagcacttttggctgatctgtctggtcctgatcaacgcaatgttgcaaatgctatattttgctcgtggatggcagttgggaacatcctaggatattcttcaggtgctagtggaaagtggaacaaatggtttcctttcttgacaactagagcttgctgtgaagcctgtggcaatcttaaagcagcatttcttgtggctgtggtgtttctgacattatgcacacttgtcaccctatattttgctgatgaggttccacttactactgcaagtcaacatcatcacttgtcagattcttctcctttactggatgaacaacaacaaaatggtgttgatttttcaaaattaaagcctttatctgttatggatgaatccaatagtaagagaactgagaatcacattgagaaagatacagagctgaagcatgggaatttcaaagctggggaagatcatgctgaaaatgtaatggatgggcctggagcggtattggtaaacttgttgacaagtttaaggcatttgccacctgccatgcattcagtcctggttgtaatggctctcacttggttgtcttggtttcccttctttctgtttgatacggattggatggggagagaagtttatcatggtgatccaaaaggggacacttctgaagtagatctttatgatcaaggagttagagaaggtgcatttggtttgctattgaattctgttgtccttggaattagctctttcttcattgaaccaatgtgtaagtggatgggtgcaaaattagtatgggcactgagcaattttatcgtctttgtttgcatggctggcactgctatcattagtcttatttcagtaagagattattctggagggatagaacacataattggagcaaatgaaggaatcaagatggcttccttggttgtgtttgttcttcttggttttcctcttgcgattacctatagtgttccctttgccgtcacagcagagttgactgctgattcaggaggtggccaaggattggctataggagttctaaatcttgcaattgttgttcctcagatgattatatcccttggttctggtccttgggatgctctctttggtggtggcaatatccctgcgtttgttttggcttccgtgtgtgctcttgccggtgctgtcattgcaactctcaaactgccagatctctctagcagttcattccagtcaacaggttttcatattggctaggcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgca

SEQ ID NO: 157 - DNA, 57 bp, Artificial Sequence
  GmSut4-2For
agcggccgcaccatggcgaatcacgaaacccaacaacaacaacaacaacatcaacgc

SEQ ID NO: 158 - DNA, 46 bp, Artificial Sequence
  GmSut4-2Rev
agcggccgcacctcatacagggcttcgaggcttttgaccaccagga

SEQ ID NO: 159 - DNA, 5079 bp, Artificial Sequence
  pLF236
cctgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacgcgttagaatactcaagctatgcatcaagcttggtaccgagctcggatccactagtaacggccgccagtgtgctggaattcaggagcggccgcacctcatacagggcttcgaggcttttgaccaccaggacggggaataaacaagacagctatgagtccactggcaagggctgcaacagctgccacaccaaaggctggagagtttcccccaccaaatagctgatcccatggtccacttcccagggaaaccaccatctgtgggaacacaattgcaagatttaggactcccattgacaatccttggccaagccccaatgactgaatgtgtgtggaaatcaaggcatatggaacgctgtaagtgattgcaagtggaaatccaagaatggtaaagattatcaatgaagctatcacaatgccagttggtggtagatctttgcctacatagccaatgttatttgccacataggttacaacaagcattgaaataaagcagacagccattaggatatttgaaattccccacagaaacccaggtccccgcttcctgcatagcctctccaagagtactgacgttactccaagaacaactgaattaagcagtaagccaagtgcccccattctaactccagtatcataattagggccttcatttggctcaccaccataaatctctcggcccatccaatcagtatcaaataggagaaatggaaaccacccaatccatgttagagcagtaacagtcagtattgtccatacaggggtcgaaaaatatctgaatgtcccaaatagctcccacaggaaagcttctcctgcagtacctgattcccctgctgctgcttcttcaacagggtgtgctccacttgaacttagaggcacttctttagctgccacaatgcttatatatgtggtgacagcaatgaaaataatgtcgagaaagaaagcagacttgagatttgcacaactaatattgcatgcaggggtaagtgtgaaagcaaaaaccttgtaccaaccactgtatgatccagttgcatatccaagaatattaccaatagccataaacagggagtaataagcatttgcaacacgtgtccttctttgatccttgccagtgagatcaccaagcaaagctctacaagggccctgagtgacgttgttagccacgtccaaaatccaaaacccgaaaacgaaaactccgacagcccaggggcgatgctcaagggtgtcgccgaaccaccacccgatgtcagcggagtgaccgatgatgagaacagcggcgacgatcgacaatgctccgcccaatataaacggtcttcggcggccaaagcggctagtgcagcggtcgctcaagtggcccaccaggggctggaccaggagcccagagagcggcccacagagccatatgatgctggcccacacgtgcgggatcccgagctgctgcacgtacggcgtgagaagagatagctgcagggcccacccgaactgaatgccaccggcaaccgacgctacccgcagcagcatcctcagcggaaccctagccggggccgccggtcgagccgctgcatgtcgacccttggaccggcggtgttggcgggggcgttgatgttgttgttgttgttgttgggtttcgtgattcgccatggtgcggccgct

SEQ ID NO: 160 - DNA, 5433 bp, Artificial Sequence
  pKR1682
ggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgcagggcatgcaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaccatggcgaatcacgaaacccaacaacaacaacaacaacatcaacgcccccgccaacaccgccggtccaagggtcgacatgcagcggctcgaccggcggccccggctagggttccgctgaggatgctgctgcgggtagcgtcggttgccggtggcattcagttcgggtgggccctgcagctatctcttctcacgccgtacgtgcagcagctcgggatcccgcacgtgtgggccagcatcatatggctctgtgggccgctctctgggctcctggtccagcccctggtgggccacttgagcgaccgctgcactagccgctttggccgccgaagaccgtttatattgggcggagcattgtcgatcgtcgccgctgttctcatcatcggtcactccgctgacatcgggtggtggttcggcgacacccttgagcatcgcccctgggctgtcggagttttcgttttcgggttttggattttggacgtggctaacaacgtcactcagggcccttgtagagctttgcttggtgatctcactggcaaggatcaaagaaggacacgtgttgcaaatgcttattactccctgtttatggctattggtaatattcttggatatgcaactggatcatacagtggttggtacaaggtttttgctttcacacttacccctgcatgcaatattagttgtgcaaatctcaagtctgctttctttctcgacattattttcattgctgtcaccacatatataagcattgtggcagctaaagaagtgcctctaagttcaagtggagcacaccctgttgaagaagcagcagcaggggaatcaggtactgcaggagaagctttcctgtgggagctatttgggacattcagatatttttcgacccctgtatggacaatactgactgttactgctctaacatggattgggtggtttccatttctcctatttgatactgattggatgggccgagagatttatggtggtgagccaaatgaaggccctaattatgatactggagttagaatgggggcacttggcttactgcttaattcagttgttcttggagtaacgtcagtactcttggagaggctatgcaggaagcggggacctgggtttctgtggggaatttcaaatatcctaatggctgtctgctttatttcaatgcttgttgtaacctatgtggcaaataacattggctatgtaggcaaagatctaccaccaactggcattgtgatagcttcattgataatctttaccattcttggatttccacttgcaatcacttacagcgttccatatgccttgatttccacacacattcagtcattggggcttggccaaggattgtcaatgggagtcctaaatcttgcaattgtgttcccacagatggtggtttccctgggaagtggaccatgggatcagctatttggtgggggaaactctccagcctttggtgtggcagctgttgcagcccttgccagtggactcatagctgtcttgtttattccccgtcctggtggtcaaaagcctcgaagccctgtatgaggtgc

SEQ ID NO: 161 - DNA, 11612 bp, Artificial Sequence
  pKR1686
ggatctggccggccggatctcgtacggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaccatggcgaatcacgaaacccaacaacaacaacaacaacatcaacgcccccgccaacaccgccggtccaagggtcgacatgcagcggctcgaccggcggccccggctagggttccgctgaggatgctgctgcgggtagcgtcggttgccggtggcattcagttcgggtgggccctgcagctatctcttctcacgccgtacgtgcagcagctcgggatcccgcacgtgtgggccagcatcatatggctctgtgggccgctctctgggctcctggtccagcccctggtgggccacttgagcgaccgctgcactagccgctttggccgccgaagaccgtttatattgggcggagcattgtcgatcgtcgccgctgttctcatcatcggtcactccgctgacatcgggtggtggttcggcgacacccttgagcatcgcccctgggctgtcggagttttcgttttcgggttttggattttggacgtggctaacaacgtcactcagggcccttgtagagctttgcttggtgatctcactggcaaggatcaaagaaggacacgtgttgcaaatgcttattactccctgtttatggctattggtaatattcttggatatgcaactggatcatacagtggttggtacaaggtttttgctttcacacttacccctgcatgcaatattagttgtgcaaatctcaagtctgctttctttctcgacattattttcattgctgtcaccacatatataagcattgtggcagctaaagaagtgcctctaagttcaagtggagcacaccctgttgaagaagcagcagcaggggaatcaggtactgcaggagaagctttcctgtgggagctatttgggacattcagatatttttcgacccctgtatggacaatactgactgttactgctctaacatggattgggtggtttccatttctcctatttgatactgattggatgggccgagagatttatggtggtgagccaaatgaaggccctaattatgatactggagttagaatgggggcacttggcttactgcttaattcagttgttcttggagtaacgtcagtactcttggagaggctatgcaggaagcggggacctgggtttctgtggggaatttcaaatatcctaatggctgtctgctttatttcaatgcttgttgtaacctatgtggcaaataacattggctatgtaggcaaagatctaccaccaactggcattgtgatagcttcattgataatctttaccattcttggatttccacttgcaatcacttacagcgttccatatgccttgatttccacacacattcagtcattggggcttggccaaggattgtcaatgggagtcctaaatcttgcaattgtgttcccacagatggtggtttccctgggaagtggaccatgggatcagctatttggtgggggaaactctccagcctttggtgtggcagctgttgcagcccttgccagtggactcatagctgtcttgtttattccccgtcctggtggtcaaaagcctcgaagccctgtatgaggtgcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgca

SEQ ID NO: 162 - DNA, 6747 bp, Artificial Sequence
  pKR1468
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagag

SEQ ID NO: 163 - DNA, 8303 bp, Artificial Sequence
  pKR1691
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 164 - DNA, 11169 bp, Artificial Sequence
  pKR1698
ggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgcatgcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaaaaaccatggctacttccgatcaagatcgccgtcacagagtcactcgcaaccgtccaccaatagctcgaccctctacttcttcatctcgtcccgttgtatctcctcctagatcaaaagtttcgaagcgtgtgcttctccgtgtagcttccgtcgcatgcgggattcaattcggatgggctcttcagctttctctcctcacaccttacgttcaagagctggggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctccttgctgatcttactgagaatgataatcgcagaacccgagttgcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtctcagcggctcatgaggtgccacttgcttcattggcttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacatagggacttcatatagtgctggggtcagtatgggtgcacttggtttgatgttgaattctgtttttcttggaatcacttctgtgctcatggagaaactttgcagaaagtggggggctggttttgtttggggaatatcaaatatcttaatggctatttgctttcttggaatgataatcacctcatttgttacgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcttaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccacatcaccaccatcaccattgagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgca

SEQ ID NO: 165 - DNA, 11129 bp, Artificial Sequence
  pKR1699
ggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgcatgcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcatgccgaatcccgaggctcaccacccctcccggtcccgggcccggccctccacgtcagccgcggcccgccccccggcccgggcccgcgtctccctccgccagcttctgcgcgtggcatcagtcgcgagcggcatccagttcgggtgggccttacagctctctctgctgacgccctacgttcagcagctggggatcccccaccaatgggccagcatcatctggctctgcggcccagtctccggcctcttcgtgcagcccctcgtcggccacatgagcgaccgctgcaccagccgctacggccgccgcaggcccttcatcctcgtcggcgccgtcgccatcgtcgccgctgttctcgtcatcgcttacgccgccgacatcggctggctcctcggcgacaccgcggactaccgccctgccgccatcaccgtcttcatcgtcggcttctggatcctcgacgtcgctaacaacgtcacgcaaggtccctgccgtgccttgctcggtgatctcactagcaaggatcctcgaaggacacgtgttgcaaatgcttattactcactgtttatggccattggtaacattcttggctatgcaactggatcatatagtggttggtacaagatttttacttttgccctttcccctgcttgcacaattagttgtgcaaatctcaagtctgctttctttcttgacattgctttcattgcggtcacaacatatatcagcatcatggcagctcatgaagtgcctctaaattcaagtgaggcggcccatgctgaagcaggggcaggggagtcaggtagtgcagaagaagctttcatgtgggaattatttgggacattcaaatattttacaacccctgtatggataattctgtctgttactgctctgacatggattgggtggttcccatttactctctttgatactgattggatgggtcgagagatttatggtggtgatccaaatcaaggccttgtttatgatactggagttagaatgggagcacttggtttgttgcttaattcagttgttcttgcattaacatcattgttcatggagaggctatgcaggaagaggggagctggttttgtgtggggaatctcaaatatcatgatgaccgtttgctttcttgcaatgctagtagtaacctatgtggcaaataacatgggctatataggcaaagatttaccaccaactggcattgtgatagctgcgttgattatctttaccattcttgggtttccactggcaatcacttatagtgttccatatgccttaatttccacacatattgagtcattgggactcggccaagggttatcaatgggtgtcctaaatctggcaatagtggtcccacagataatagtgtcactgggaagtggaccatgggatcagctatttggtggaggaaactccccagcctttgctgtggcagctgtttcagcccttatcagtggactcatagctgtgttggctattcctcgatctggtgctcaaaaggctcgaagccatgtatgagcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgca

SEQ ID NO: 166 - DNA, 11423 bp, Artificial Sequence
  pKR1700
ggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgcatgcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaccatgatgacggggaagtctgacttgttgtcgatccgcgttccctacaagaatctccaccacgattcctccgcccccgaactcgaactcgtcgacgtcaaccaccgcaacttgccaccatcaccgccaccgccaaatcactctccctcgccgccgaacaacaacaacatcaacgctccgttgcttcatctcgttctcagttgcaccgtcgccgccggcgtccaattcggctgggccttgcagctctctctcttgacgccctacattcagacgttgggaataggacatgcgttttcttcgtttatttggctctgtggccccattacaggtcttgtggttcaaccatgcgttggtatttggagtgataaatgtacttcaaggtttggcagaagacggccgttcattctggcaggatctcttatgatatgtctggctgtgatattaatcggattttctgctgacattggatatgtattaggtgatacacatgagcattgcagaacatttaaagggacccgaacaagggctgctcttgtatttattcttgggttctggatgctggaccttgctaacaacacagtgcaggggccagctcgagcacttttggctgatctgtctggtcctgatcaacgcaatgttgcaaatgctatattttgctcgtggatggcagttgggaacatcctaggatattcttcaggtgctagtggaaagtggaacaaatggtttcctttcttgacaactagagcttgctgtgaagcctgtggcaatcttaaagcagcatttcttgtggctgtggtgtttctgacattatgcacacttgtcaccctatattttgctgatgaggttccacttactactgcaagtcaacatcatcacttgtcagattcttctcctttactggatgaacaacaacaaaatggtgttgatttttcaaaattaaagcctttatctgttatggatgaatccaatagtaagagaactgagaatcacattgagaaagatacagagctgaagcatgggaatttcaaagctggggaagatcatgctgaaaatgtaatggatgggcctggagcggtattggtaaacttgttgacaagtttaaggcatttgccacctgccatgcattcagtcctggttgtaatggctctcacttggttgtcttggtttcccttctttctgtttgatacggattggatggggagagaagtttatcatggtgatccaaaaggggacacttctgaagtagatctttatgatcaaggagttagagaaggtgcatttggtttgctattgaattctgttgtccttggaattagctctttcttcattgaaccaatgtgtaagtggatgggtgcaaaattagtatgggcactgagcaattttatcgtctttgtttgcatggctggcactgctatcattagtcttatttcagtaagagattattctggagggatagaacacataattggagcaaatgaaggaatcaagatggcttccttggttgtgtttgttcttcttggttttcctcttgcgattacctatagtgttccctttgccgtcacagcagagttgactgctgattcaggaggtggccaaggattggctataggagttctaaatcttgcaattgttgttcctcagatgattatatcccttggttctggtccttgggatgctctctttggtggtggcaatatccctgcgtttgttttggcttccgtgtgtgctcttgccggtgctgtcattgcaactctcaaactgccagatctctctagcagttcattccagtcaacaggttttcatattggctaggcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgca

SEQ ID NO: 167 - DNA, 11159 bp, Artificial Sequence
  pKR1701
ggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgcatgcctgcaggagatccaagcttgtaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaccatggcgaatcacgaaacccaacaacaacaacaacaacatcaacgcccccgccaacaccgccggtccaagggtcgacatgcagcggctcgaccggcggccccggctagggttccgctgaggatgctgctgcgggtagcgtcggttgccggtggcattcagttcgggtgggccctgcagctatctcttctcacgccgtacgtgcagcagctcgggatcccgcacgtgtgggccagcatcatatggctctgtgggccgctctctgggctcctggtccagcccctggtgggccacttgagcgaccgctgcactagccgctttggccgccgaagaccgtttatattgggcggagcattgtcgatcgtcgccgctgttctcatcatcggtcactccgctgacatcgggtggtggttcggcgacacccttgagcatcgcccctgggctgtcggagttttcgttttcgggttttggattttggacgtggctaacaacgtcactcagggcccttgtagagctttgcttggtgatctcactggcaaggatcaaagaaggacacgtgttgcaaatgcttattactccctgtttatggctattggtaatattcttggatatgcaactggatcatacagtggttggtacaaggtttttgctttcacacttacccctgcatgcaatattagttgtgcaaatctcaagtctgctttctttctcgacattattttcattgctgtcaccacatatataagcattgtggcagctaaagaagtgcctctaagttcaagtggagcacaccctgttgaagaagcagcagcaggggaatcaggtactgcaggagaagctttcctgtgggagctatttgggacattcagatatttttcgacccctgtatggacaatactgactgttactgctctaacatggattgggtggtttccatttctcctatttgatactgattggatgggccgagagatttatggtggtgagccaaatgaaggccctaattatgatactggagttagaatgggggcacttggcttactgcttaattcagttgttcttggagtaacgtcagtactcttggagaggctatgcaggaagcggggacctgggtttctgtggggaatttcaaatatcctaatggctgtctgctttatttcaatgcttgttgtaacctatgtggcaaataacattggctatgtaggcaaagatctaccaccaactggcattgtgatagcttcattgataatctttaccattcttggatttccacttgcaatcacttacagcgttccatatgccttgatttccacacacattcagtcattggggcttggccaaggattgtcaatgggagtcctaaatcttgcaattgtgttcccacagatggtggtttccctgggaagtggaccatgggatcagctatttggtgggggaaactctccagcctttggtgtggcagctgttgcagcccttgccagtggactcatagctgtcttgtttattccccgtcctggtggtcaaaagcctcgaagccctgtatgaggtgcggccgcctgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcaagtcctattttcttaatcattgctttgttttaacgtacctagatttcataacttttgtctttgtctcaagctgaacctaatgatgatagtaatattaacttattgtataggggtatttcataggataaaaaatgatgtgcaattacgtgtagaccaaatattacttgatgacagatggcctgca

SEQ ID NO: 168 - DNA, 6772 bp, Artificial Sequence
  pKR1363
ggccgcgcatgctgacttaatcagctaacgccactcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgctcgggcgcgccggtacccgggtaccgagctcactagacgcggtgaaattacctaattaacaccggtgtttaaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccaccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgggccggcccagctgatgatcccggtgaagttcctattccgaagttcctattctccagaaagtataggaacttcactagagcttgcggcc

SEQ ID NO: 169 - DNA, 9895 bp, Artificial Sequence
  pKR1331
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctcaaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactcaagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtaggc

SEQ ID NO: 170 - DNA, 10192 bp, Artificial Sequence
  pKR1365
ggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctcaaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactcaagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtaggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgtctagaggatcaaacaccggtgttaattaggtaatttcaccgcgtctagtgagctcggtacccgggtaccggcgcgcccgagcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccggtaccgggccccccctcgagtggcgttagctgattaagtcagcatgcgcggccggccgcaagctctagtgaagttcctatactttctggagaataggaacttcggaataggaacttcaccgggatcatcagctgggccggcccagctgatgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggtggaagttcctatactttctagagaataggaacttcggaataggaacttctgttgttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttgggaagggcgaattccagcacactggcggccgttactagtgtttagcttactagagtcgacctgca

SEQ ID NO: 171 - DNA, 10156 bp, Artificial Sequence
  pKR1374
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgtctagaggatcaaacaccggtgttaattaggtaatttcaccgcgtctagtgagctcggtacccgggtaccggcgcgcccgagcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccggtaccgggccccccctcgagtggcgttagctgattaagtcagcatgcgcggccggccgcaagctctagtgaagttcctatactttctggagaataggaacttcggaataggaacttcaccgggatcatcagctgggccggcccagctgatgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggtggaagttcctatactttctagagaataggaacttcggaataggaacttctgttgttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttgggaagggcgaattccagcacactggcggccgttactagtgtttagcttactagagtcgacctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 172 - DNA, 4176 bp, Artificial Sequence
  pKR1598
ctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagacttaattaaggatccggcgcgcccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtttaaacagtcgact

SEQ ID NO: 173 - DNA, 5732 bp, Artificial Sequence
  pKR1600
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagacttaattaaggatccggcgcgcccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtttaaacagtcgactctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 174 - DNA, 9840 bp, Artificial Sequence
  pKR1602
gtacgtctagaggatcaaacaccggtgttaattaggtaatttcaccgcgtctagtgagctcggtacccgggtaccggcgcgcccgagcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccggtaccgggccccccctcgagtggcgttagctgattaagtcagcatgcgcggccggccgcaagctctagtgaagttcctatactttctggagaataggaacttcggaataggaacttcaccgggatcatcagctgggccggcccagctgatgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggtggaagttcctatactttctagagaataggaacttcggaataggaacttctgttgttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttgggaagggcgaattccagcacactggcggccgttactagtgtttagcttactagagtcgacctgcaggtttaaacagtcgactctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcac

SEQ ID NO: 175 - DNA, 10126 bp, Artificial Sequence
  pKR1658
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgtctagaggatcaaacaccggtgttaattaggtaatttcaccgcgtctagtgagctcggtacccgggtaccggcgcgcccgagcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccggtaccgggccccccctcgagtggcgttagctgattaagtcagcatgcgcggccggccgcaagctctagtgaagttcctatactttctggagaataggaacttcggaataggaacttcaccgggatcatcagctgggccggcccagctgatgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggtggaagttcctatactttctagagaataggaacttcggaataggaacttctgttgttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttgggaagggcgaattccagcacactggcggccgttactagtgtttagcttactagagtcgacctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgccgaatcccgaggctcaccacccctcccggtcccgggcccggccctccacgtcagccgcggcccgccccccggcccgggcccgcgtctccctccgccagcttctgcgcgtggcatcagtcgcgagcggcatccagttcgggtgggccttacagctctctctgctgacgccctacgttcagcagctggggatcccccaccaatgggccagcatcatctggctctgcggcccagtctccggcctcttcgtgcagcccctcgtcggccacatgagcgaccgctgcaccagccgctacggccgccgcaggcccttcatcctcgtcggcgccgtcgccatcgtcgccgctgttctcgtcatcgcttacgccgccgacatcggctggctcctcggcgacaccgcggactaccgccctgccgccatcaccgtcttcatcgtcggcttctggatcctcgacgtcgctaacaacgtcacgcaaggtccctgccgtgccttgctcggtgatctcactagcaaggatcctcgaaggacacgtgttgcaaatgcttattactcactgtttatggccattggtaacattcttggctatgcaactggatcatatagtggttggtacaagatttttacttttgccctttcccctgcttgcacaattagttgtgcaaatctcaagtctgctttctttcttgacattgctttcattgcggtcacaacatatatcagcatcatggcagctcatgaagtgcctctaaattcaagtgaggcggcccatgctgaagcaggggcaggggagtcaggtagtgcagaagaagctttcatgtgggaattatttgggacattcaaatattttacaacccctgtatggataattctgtctgttactgctctgacatggattgggtggttcccatttactctctttgatactgattggatgggtcgagagatttatggtggtgatccaaatcaaggccttgtttatgatactggagttagaatgggagcacttggtttgttgcttaattcagttgttcttgcattaacatcattgttcatggagaggctatgcaggaagaggggagctggttttgtgtggggaatctcaaatatcatgatgaccgtttgctttcttgcaatgctagtagtaacctatgtggcaaataacatgggctatataggcaaagatttaccaccaactggcattgtgatagctgcgttgattatctttaccattcttgggtttccactggcaatcacttatagtgttccatatgccttaatttccacacatattgagtcattgggactcggccaagggttatcaatgggtgtcctaaatctggcaatagtggtcccacagataatagtgtcactgggaagtggaccatgggatcagctatttggtggaggaaactccccagcctttgctgtggcagctgtttcagcccttatcagtggactcatagctgtgttggctattcctcgatctggtgctcaaaaggctcgaagccatgtatgagc

SEQ ID NO: 176 - DNA, 13144 bp, Artificial Sequence
  pKR1661
gtacgtctagaggatcaaacaccggtgttaattaggtaatttcaccgcgtctagtgagctcggtacccgggtaccggcgcgcccgagcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccggtaccgggccccccctcgagtggcgttagctgattaagtcagcatgcgcggccggccgcaagctctagtgaagttcctatactttctggagaataggaacttcggaataggaacttcaccgggatcatcagctgggccggcccagctgatgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggtggaagttcctatactttctagagaataggaacttcggaataggaacttctgttgttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttgggaagggcgaattccagcacactggcggccgttactagtgtttagcttactagagtcgacctgcaggtttaaacagtcgactctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgccgaatcccgaggctcaccacccctcccggtcccgggcccggccctccacgtcagccgcggcccgccccccggcccgggcccgcgtctccctccgccagcttctgcgcgtggcatcagtcgcgagcggcatccagttcgggtgggccttacagctctctctgctgacgccctacgttcagcagctggggatcccccaccaatgggccagcatcatctggctctgcggcccagtctccggcctcttcgtgcagcccctcgtcggccacatgagcgaccgctgcaccagccgctacggccgccgcaggcccttcatcctcgtcggcgccgtcgccatcgtcgccgctgttctcgtcatcgcttacgccgccgacatcggctggctcctcggcgacaccgcggactaccgccctgccgccatcaccgtcttcatcgtcggcttctggatcctcgacgtcgctaacaacgtcacgcaaggtccctgccgtgccttgctcggtgatctcactagcaaggatcctcgaaggacacgtgttgcaaatgcttattactcactgtttatggccattggtaacattcttggctatgcaactggatcatatagtggttggtacaagatttttacttttgccctttcccctgcttgcacaattagttgtgcaaatctcaagtctgctttctttcttgacattgctttcattgcggtcacaacatatatcagcatcatggcagctcatgaagtgcctctaaattcaagtgaggcggcccatgctgaagcaggggcaggggagtcaggtagtgcagaagaagctttcatgtgggaattatttgggacattcaaatattttacaacccctgtatggataattctgtctgttactgctctgacatggattgggtggttcccatttactctctttgatactgattggatgggtcgagagatttatggtggtgatccaaatcaaggccttgtttatgatactggagttagaatgggagcacttggtttgttgcttaattcagttgttcttgcattaacatcattgttcatggagaggctatgcaggaagaggggagctggttttgtgtggggaatctcaaatatcatgatgaccgtttgctttcttgcaatgctagtagtaacctatgtggcaaataacatgggctatataggcaaagatttaccaccaactggcattgtgatagctgcgttgattatctttaccattcttgggtttccactggcaatcacttatagtgttccatatgccttaatttccacacatattgagtcattgggactcggccaagggttatcaatgggtgtcctaaatctggcaatagtggtcccacagataatagtgtcactgggaagtggaccatgggatcagctatttggtggaggaaactccccagcctttgctgtggcagctgtttcagcccttatcagtggactcatagctgtgttggctattcctcgatctggtgctcaaaaggctcgaagccatgtatgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaac

SEQ ID NO: 177 - DNA, 1715 bp, Helianthus annuus
gcacgaggtaattcacccacaattccgatcatacaccaacaacatggtggtgccggtaagtcaaccgcaacgccaccgtcaaccgccggaaaccccatcaagaatccgactccgaaccctcctccgagtcgcatcagtagcttgcggaatccaattcggctgggccttacaactatctctactaaccccatacgtacaagaactcggaataccgcacgtatggtccagtatcatctggttgtgtggaccgttatccggtttttttgtccagccacttgctggccatatgagtgaccggtccaccagccggttcgggcgacgcaggccgtttattgttgtggggtgtgggtcgatcattttgtcggtgcttttgatcggttttgctgcggatattggggggtggttgggtgatggggagaccaagacgcgtgcgattgtggtgtttgttattgggttttggtttttggatatggcgaataatgctactcaaggcccttgtagagctttgcttgctgatcttactgggaaggatcaccgaagaactcgagttgcaaacgcatatttctcccttttcatggcagttggtaatgttctcgggtacgcaactggagcttatagtggttggtacaagcttttcccgtttaccttaaactcttcatgtgacattaactgtgcaaacctcaaagccgccttccttctcgatgttattttcatcacatgcactacatacataagtgtgaccgcaattcacgagcaaccaataacttccgttcatgatgctattaatcaagaatcaagccatccccaagaagcattcttctgggaaatgtttgggacgtttaaataccttccgaggcccgtttggttgatcctgttcgtcacttcgttaacttggatcgggtggtttccgttcattctttttgatacagattggatgggtagagagatttacggtggggatccaatcggtgaccaaaagtatagtgaaggtgttagaatgggtgcgtttgggctcatgttgaattcggttattcttggaataacgtctgtgcttatggagaatctttgtaggagatggggttccggttttatctgggggatttcgaatattattatgtttctttgctttctagcaatgcttgtgctttcgtttgtggcaagcaaaacggattatgacagcgatggtttgcctccaaacgggatcgtgatcgctgcgttggttatttttgcaattcttggcatgccattggctgtgacgtatagtgtcccatatgcgttggtatcctcacggatcgagtctctaggacttggtcaagggttgtcgatgggtgttctaaatgtctccattgttctcccacaggttgtggtgtctcttggaagtggaccgtgggacgcgttatttggtggaggtaactctccagccctcgctgtagcagcagttgcagcctttgcaagtgggctcgtagccatcttggctattcctcgctctaggcccgaaaaatccaaaattcgacaatgagaagaatgttattttttgatcgacccgagtgaagatgtattgttgttgtattgtgttttctgttttgtatttacatatatctttgtgacaagggagtctcagtctactgcaaacaattggtctgaattttgtgtatagcagcgcgtgtttagtggcaataatattattaccatgatacaaaaaaaaaaaaaaaaaa

SEQ ID NO: 178 - protein, 491 aa, Helianthus annuus
MVVPVSQPQRHRQPPETPSRIRLRTLLRVASVACGIQFGWALQLSLLTPYVQELGIPHVWSSIIWLCGPLSGFFVQPLAGHMSDRSTSRFGRRRPFIVVGCGSIILSVLLIGFAADIGGWLGDGETKTRAIVVFVIGFWFLDMANNATQGPCRALLADLTGKDHRRTRVANAYFSLFMAVGNVLGYATGAYSGWYKLFPFTLNSSCDINCANLKAAFLLDVIFITCTTYISVTAIHEQPITSVHDAINQESSHPQEAFFWEMFGTFKYLPRPVWLILFVTSLTWIGWFPFILFDTDWMGREIYGGDPIGDQKYSEGVRMGAFGLMLNSVILGITSVLMENLCRRWGSGFIWGISNIIMFLCFLAMLVLSFVASKTDYDSDGLPPNGIVIAALVIFAILGMPLAVTYSVPYALVSSRIESLGLGQGLSMGVLNVSIVLPQVVVSLGSGPWDALFGGGNSPALAVAAVAAFASGLVAILAIPRSRPEKSKIRQ

SEQ ID NO: 179 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 180 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 181 - DNA, 1581 bp, Yarrowia lipolytica
atggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctccaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactccagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtag

SEQ ID NO: 182 - protein, 526 aa, Yarrowia lipolytica
MEVRRRKIDVLKAQKNGYESGPPSRQSSQPSSRASSRTRNKHSSSTLSLSGLTMKVQKKPAGPPANSKTPFLHIKPVHTCCSTSMLSRDYDGSNPSFKGFKNIGMIILIVGNLRLAFENYLKYGISNPFFDPKITPSEWQLSGLLIVVAYAHILMAYAIESAAKLLFLSSKHHYMAVGLLHTMNTLSSISLLSYVVYYYLPNPVAGTIVEFVAVILSLKLASYALTNSDLRKAAIHAQKLDKTQDDNEKESTSSSSSSDDAETLADIDVIPAYYAQLPYPQNVTLSNLLYFWFAPTLVYQPVYPKTERIRPKHVIRNLFELVSLCMLIQFLIFQYAYPIMQSCLALFFQPKLDYANISERLMKLASVSMMVWLIGFYAFFQNGLNLIAELTCFGNRTFYQQWWNSRSIGQYWTLWNKPVNQYFRHHVYVPLLARGMSRFNASVVVFFFSAVIHELLVGIPTHNIIGAAFFGMMSQVPLIMATENLQHINSSLGPFLGNCAFWFTFFLGQPTCAFLYYLAYNYKQNQ

SEQ ID NO: 183 - DNA, 1545 bp, Yarrowia lipolytica
atgaccatcgactcccagtactacaagtcccgcgacaagaacgacaccgctcccaagattgctggtatccgctacgctcctctgtctactccactcttgaaccgctgcgagactttctctttggtgtggcacatcttctccatccctaccttcctcaccatcttcatgctctgctgtgccattcccttgctctggcccttcgtgatcgcttacgttgtgtacgccgtgaaggatgactccccttccaacggcggtgttgtgaagcgctattcccctatctcccgcaacttcttcatctggaagctctttggccgctacttccccatcaccctccacaagaccgttgatttggagcccacccacacttactatcccttggacgtccaagagtaccacctgattgctgagcgctattggcctcagaacaagtacctgcgcgccatcattaccaccatcgagtacttcctgcccgctttcatgaagcgttccctctccatcaacgagcaggagcagcctgctgagagagaccctctgttgtctcccgtttccccctcttctcctggttctcagcccgacaagtggatcaaccatgattcccgctattccagaggtgagtcctctggctccaatggtcatgcttctggctctgaactgaatggcaatggcaacaacggcactaccaatcgccgccctctttcttctgcttccgctggctctactgcttctgactctaccttgctcaacggctctctcaactcctacgccaaccagatcattggcgagaacgaccctcagttgtctcccactaagctcaagcctactggcaggaagtacatcttcgggtaccatcctcacggtatcattgggatgggcgcctttggtggcattgctactgaaggtgctggctggtccaagctctttcctggtatccccgtttccctcatgaccctcaccaacaactttcgcgttcctctctatcgcgagtacctcatgtccctgggcgttgcttccgtttctaagaagtcctgtaaggccctcctcaagcgtaatcagtccatctgcatcgtggtgggtggtgcccaggaatccttgttggctaggcctggtgttatggatctcgtgttgctgaagcgcaagggttttgtgcgcttgggtatggaggtgggcaatgttgccctcgttccaatcatggctttcggcgagaacgatctctacgaccaggtgtccaacgacaagtcctccaagctgtaccgcttccagcagttcgtgaagaacttcctcggcttcaccctccctctcatgcatgccagaggtgtgttcaactacgatgttgggctcgttccctaccgccgccctgtgaacattgtggttggttctcctatcgacttgccttacctccctcatcccaccgatgaggaagtttccgagtaccacgaccgttacatcgctgagctccagcgcatctacaacgagcacaaggacgagtacttcatcgactggactgaggagggtaagggcgctcctgagtttcgtatgatcgagtag

SEQ ID NO: 184 - protein, 514 aa, Yarrowia lipolytica; identical to SEQ ID NO: 180

SEQ ID NO: 185 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 186 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLFREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 187 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 188 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLLREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 189 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacaaagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 190 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYKEYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 191 - protein, 526 aa, Yarrowia lipolytica; identical to SEQ ID NO: 182

That which is claimed:

1. A soybean plant seed with increased oil content comprising in its genome:
   (a) a first recombinant DNA construct comprising a first polynucleotide operably linked to at least one first regulatory element, wherein the first polynucleotide comprises a diacylglycerol acyltransferase (DGAT) coding region encoding a polypeptide having at least 95% sequence identity to SEQ ID NO:180, based on the Clustal W method of alignment with pairwise alignment default parameters of KTUPLE=1, GAP PENALTY=3, WINDOW=5 and DIAGONALS SAVED=5, wherein the DGAT polypeptide has DGAT activity;
   (b) a second recombinant DNA construct comprising a second polynucleotide operably linked to at least one second regulatory element, wherein the second polynucleotide encodes a SUT2 sucrose transporter polypeptide, wherein the SUT2 sucrose transporter polypeptide has at least 95% sequence identity to SEQ ID NO: 34 or 36, based on the Clustal W method of alignment with pairwise alignment default parameters of KTUPLE=1, GAP PENALTY=3, WINDOW=5 and DIAGONALS SAVED=5; and
   (c) wherein the soybean plant seed exhibits increased oil content as a percentage of seed weight when compared to a control soybean plant seed comprising the first recombinant DNA construct but not comprising the second recombinant DNA construct.

2. The plant seed of claim 1, wherein the first polynucleotide encodes a polypeptide having the amino acid sequence of SEQ ID NO:180, 184, 186, 188, or 190.

3. The plant seed of claim 1, wherein the second polynucleotide a polypeptide having at least 95% sequence identity to SEQ ID NO: 34 or 36 based on the Clustal W method of alignment with pairwise alignment default parameters of KTUPLE=1, GAP PENALTY=3, WINDOW=5 and DIAGONALS SAVED=5.

4. A soybean plant grown from the seed of claim 1.

5. A method of increasing oil content in a soybean plant seed comprising:
   (a) introducing into a regenerable soybean plant cell:
      (i) a first recombinant DNA construct comprising a first polynucleotide encoding a DGAT polypeptide having at least 95% sequence identity to SEQ ID NO:180, based on the Clustal W method of alignment with pairwise alignment default parameters of KTUPLE=1, GAP PENALTY=3, WINDOW=5 and DIAGONALS SAVED=5, and
      (ii) a second recombinant DNA construct comprising a second polynucleotide encoding a SUT2 sucrose transporter polypeptide, wherein the SUT2 sucrose transporter polypeptide has at least 95% sequence identity to SEQ ID NO: 34 or 36, based on the Clustal W method of alignment with pairwise default parameters of KTUPLE=1, GAP PENALTY=3, WINDOW=5 and DIAGONALS SAVED=5;
   (b) regenerating a transgenic plant from the regenerable plant cell after step (a), wherein the transgenic plant comprises in its genome the first recombinant DNA construct and the second recombinant DNA construct; and,
   (c) obtaining a progeny plant derived from the transgenic plant of step (b), wherein the progeny plant comprises in its genome the first recombinant DNA construct and the second recombinant DNA construct, wherein the progeny plant exhibits increased oil content as a percentage of seed weight when compared to a control soybean plant comprising the first recombinant DNA construct but not comprising the second recombinant DNA construct.

6. The method of claim 5, wherein the second polynucleotide encodes a polypeptide having the amino acid sequence of SEQ ID NO: 34 or 36.

7. The method of claim 5, wherein the recombinant DNA construct encoding the SUT2 polypeptide comprises an amino acid sequence of at least 95% sequence identity to SEQ ID NO: 36, based on the Clustal W method of alignment with pairwise default parameters of KTUPLE=1, GAP PENALTY=3, WINDOW=5 and DIAGONALS SAVED=5.

8. The method of claim 5, wherein the first polynucleotide encodes a polypeptide having the amino acid sequence of SEQ ID NO:180, 184, 186, 188 or 190.

9. A method of evaluating increased seed oil content in a soybean plant seed comprising:
   evaluating seed from a progeny plant grown from a transgenic plant for increased oil content, the transgenic plant comprising in its genome:
      (i) a first recombinant DNA construct comprising a first polynucleotide encoding a DGAT polypeptide having at least 95% sequence identity to SEQ ID NO:180, based on the Clustal W method of alignment with pairwise alignment default parameters of KTUPLE=1, GAP PENALTY=3, WINDOW=5 and DIAGONALS SAVED=5, wherein the DGAT polypeptide has DGAT activity; and
      (ii) a second recombinant DNA construct comprising a second polynucleotide encoding a SUT2 sucrose transporter polypeptide, wherein the SUT2 sucrose transporter polypeptide has at least 95% sequence identity to SEQ ID NO: 34 or 36, based on the Clustal W method of alignment with pairwise alignment default parameters of KTUPLE=1, GAP PENALTY=3, WINDOW=5 and DIAGONALS SAVED=5;

wherein the progeny plant comprises in its genome the first recombinant DNA construct and the second recombinant DNA construct; and wherein the seed from the progeny plant shows increased oil content compared to a control soybean plant not comprising the first recombinant DNA construct and the second recombinant DNA construct.

10. The method of claim 9, wherein the second polynucleotide encodes a polypeptide having an amino acid sequence of SEQ ID NO: 34 or 36.

11. The method of claim 9, wherein the recombinant DNA construct encoding the SUT2 polypeptide comprises a polypeptide having an amino acid sequence of at least 95% sequence identity to SEQ ID NO: 36, based on the Clustal W method of alignment with pairwise alignment default parameters of KTUPLE=1, GAP PENALTY=3, WINDOW=5 and DIAGONALS SAVED=5.

12. The method of claim 9, wherein the first polynucleotide encodes a polypeptide having the amino acid sequence of SEQ ID NO: 180, 184, 186, 188, or 190.

13. The plant seed of claim 1, wherein the first regulatory element comprises a seed-specific promoter, and wherein the second regulatory element comprises a different seed-specific promoter.

14. The plant seed of claim 13, wherein the first seed-specific promoter, the second seed-specific promoter or a combination thereof is selected from the group consisting of the alpha prime subunit of beta conglycinin promoter, soybean sucrose synthase promoter, kunitx trypsin inhibitor 3 promoter, annexin promoter, Gly1 promoter, beta subunit of beta conglycinin promoter, P34/Gly Bd m 30 K promoter, albumin promoter, Leg A1 promoter and Leg A2 promoter.

15. The plant seed of claim 1, wherein the plant seed exhibits an overall increased oil content of 1% or greater when compared to the control plant.

16. The plant seed of claim 1, wherein the plant seed exhibits an overall increased oil content of 5% or greater when compared to the control plant.

17. The plant seed of claim 1, wherein the plant seed exhibits an overall increased oil content of 10% or greater when compared to the control plant.

18. The method of claim 5, wherein the first regulatory sequence comprises a seed-specific promoter, and wherein the second regulatory sequence comprises a different seed-specific promoter.

19. The method of claim 5, wherein the plant seed exhibits an overall increased oil content of 1% or greater when compared to control plant.

20. The method of claim 5, wherein the plant seed exhibits an overall increased oil content of 5% or greater when compared to the control plant.

21. The method of claim 5, wherein the plant seed exhibits an overall increased oil content of 10% or greater when compared to the control plant.

* * * * *